United States Patent
Bartenschlager

(12) 
(10) Patent No.: US 6,630,343 B1
(45) Date of Patent: Oct. 7, 2003

(54) HEPATITIS C VIRUS CULTURE SYSTEM

(76) Inventor: Ralf Bartenschlager, Nachdem Alten Schloss 22, D-55239 Gau-Odernheim (DE)

( * ) Notice: Subject to any disclaimer, the term of this patent is extended or adjusted under 35 U.S.C. 154(b) by 0 days.

(21) Appl. No.: 09/539,601

(22) Filed: Mar. 31, 2000

(30) Foreign Application Priority Data

Apr. 3, 1999 (DE) .......................................... 199 15 178

(51) Int. Cl.$^7$ .............................. C12N 15/74; C12N 5/08
(52) U.S. Cl. ...................... 435/320.1; 435/5; 435/69.1; 435/67.7; 435/239; 435/370; 536/23.4; 536/23.72
(58) Field of Search .......................... 536/23.4, 23.72; 435/5, 239, 320.1, 69.1, 69.7, 370

(56) References Cited

FOREIGN PATENT DOCUMENTS

| DE | 2719581 | 11/1977 |
|----|---------|---------|
| EP | 0496705 | 1/1992 |
| EP | 0722719 | 1/1996 |

OTHER PUBLICATIONS

Lohmann et al., Replication of Subgenomic Hepatitis C Virus RNAs in a Hepatoma Cell Line. Science 285:110–113, Jul. 2, 1999.*

Gerardo Kaplan and Vincent R. Racaniello, *Construction and Characterization of Poliovirus Subgenomic Replicons*, Journal of Virology, vol. 62, No. 5, p. 1687–96 (May 1988).

Robert E. Lanford, Camille Sureau, James R. Jacob, Robert White, and Thomas R. Fuerst, *Demonstration of in Vitro Infection of Chimpanzee Hepatocytes with Hepatitis C Virus Using Strand–Specific RT/PCR*, Virology, 202, p. 606–14 (1994).

Byoung J. Yoo, Mark J. Selby, Joonho Choe, Byung S. Suh, Steven H. Choi, Jean S. Joh, Gerald J. Nuovo, Hyo–Suk Lee, Michael Houghton, and Jang H. Han, *Transfection of a Differentiated Human Hepatoma Cell Line (Huh7) with In Vitro–Transcribed Hepatitis C Virus (HCV) RNA and Establishment of a Long–Term Culture Persistently Infected with HCV*, Journal of Virology, vol. 69, No. 1, p. 32–38 (Jan. 1995).

H.–U. Schulz, M. Schürer, G. Krumbiegel, W. Wächter, R. Weyhenmeyer, and G. Seidel, *Investigation of Dissolution and Bioequivalence of Silymarin Products*, Arzneim.–Forsch./Drug Res., 45(I), No. 1, p. 61–64 (1995).

Alexander Khromykh and Edwin G. Westaway, *Subgenomic Replicons of the Flavivirus Kunjin: Construction and Applications*, Journal of Virology, vol. 71, No. 2, p. 1497–1505 (Feb. 1997).

Srikanta Dash, Abdel–Baset Halim, Hideyuki Tsuji, Naoki Hiramatsu, and Michael A. Gerger, *Transfection of HepG2 Cells with Infectious Hepatitis C Virus Genome*, American Journal of Pathology, vol. 151, No. 2, p. 361, 362–373 (Aug. 1997).

Sven–Erik Behrens, Claus W. Grassmann, Heinz–Jürgen Thiel, Gregor Meyers, and Norbert Tautz, *Characterization of an Autonomus Subgenomic Pestivirus RNA Replicon*, Journal of Virology, vol. 72, No. 3, p. 2364–72 (Mar. 1998).

Ilya Frolov, Eugene Agapov, Thomas A. Hoffman, Jr., Béla M. Prágal, Mara Lippa, Sondra Schlesinger, and Charles M. Rice, *Selection of RNA Replicons Capable of Persistent Noncytopathic Replication in Mammalian Cells*, Journal of Virology, vol. 73, No. 5, p. 3854–65 (May 1999).

* cited by examiner

*Primary Examiner*—Donna C Wortman
(74) *Attorney, Agent, or Firm*—Pendorf & Cutliff

(57) ABSTRACT

The hepatitis C virus (HCV) cell culture system according to the invention consists of human hepatoma cells, which are transfected with a HCV-RNA construct, that comprises the HCV specific RNA segments 5'to NTR, NS3, NS4A, NS4B, NS5A, NS5B, and 3'to NTR as well as a minimum of one marker gene for selection (selection gene).

17 Claims, 13 Drawing Sheets

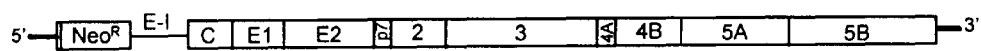
Fig. 4
A
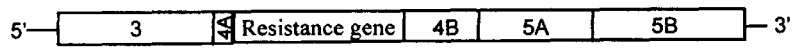
B
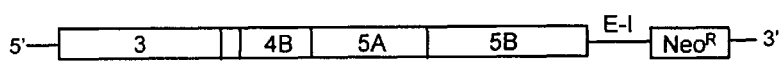
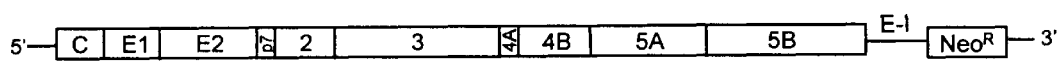
Fig. 5

A
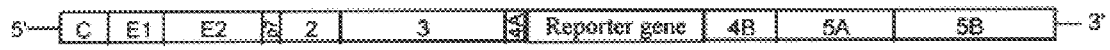
B
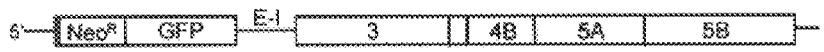
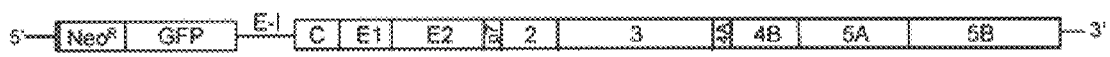
C
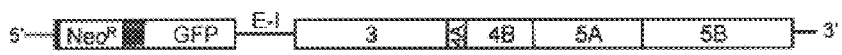
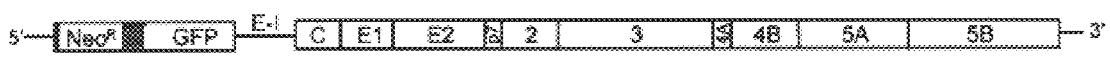
D
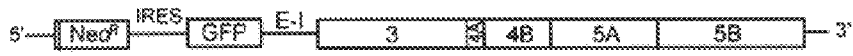
Fig. 6

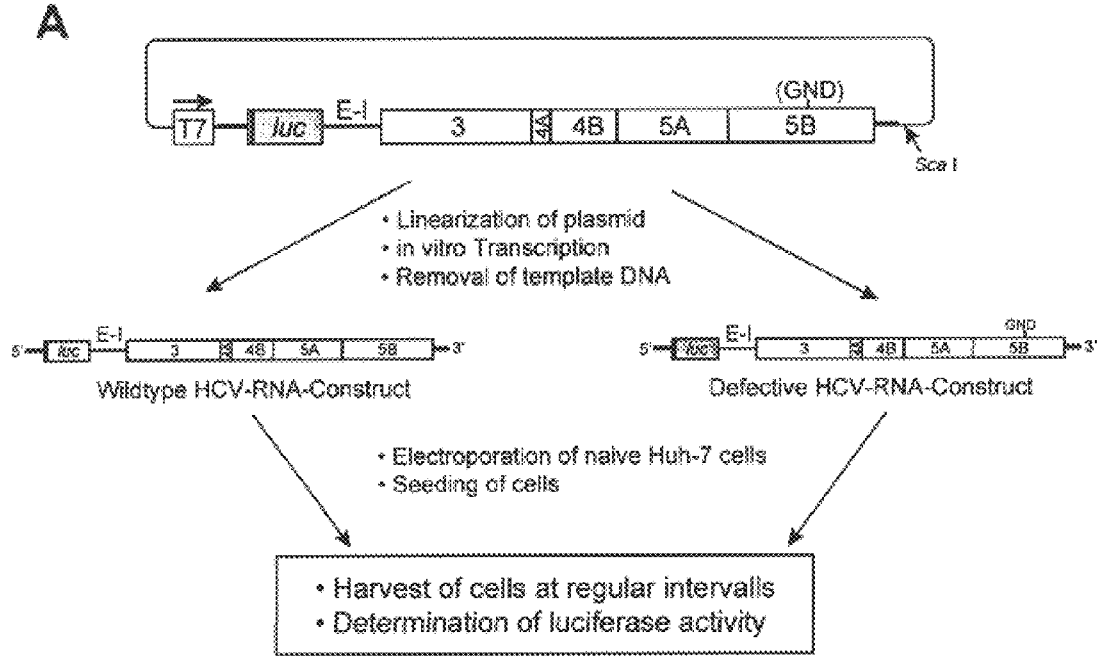
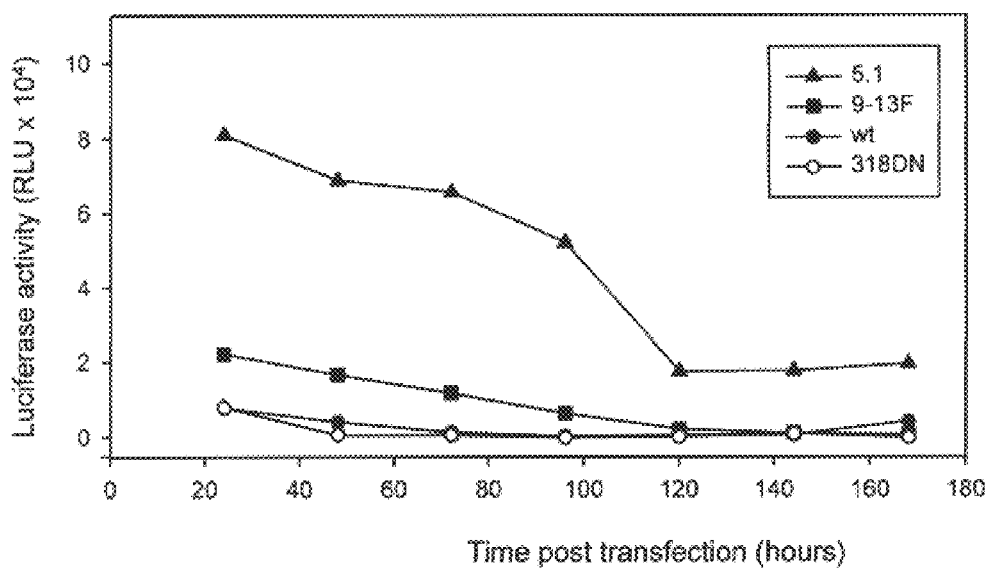
Fig. 11

HEPATITIS C VIRUS CULTURE SYSTEM

BACKGROUND OF THE INVENTION

1. Field of the Invention

The invention relates to a hepatitis C virus (HCV) cell culture system, which comprises mainly eukaryotic cells containing transfected HCV specific genetic material, which means they are transfected with HCV specific genetic material.

2. Background Information

The hepatitis C virus (HCV) is one of the main causes worldwide of chronic and sporadic liver diseases. The history of most HCV infections does not involve any obvious clinical signs, but 80–90% of the infected people become chronic carriers of the virus and 50% of these chronic carriers of the virus develop chronic hepatitis with different degrees of severity. Approx. 20% of the chronically infected develop a cirrhosis of the liver over 10 to 20 years, based on what a primary hepatocellular carcinoma can develop. Nowadays chronic hepatitis C is the main indication for liver transplantation. One currently available therapy involves high-dose administration of Interferon alpha or a combination of Interferon alpha and the purine nucleoside analogue Ribavirin. However, only approx. 60% of all treated persons respond to this therapy and with these, a new viraemia occurs in more than half of all cases after the discontinuation of the treatment.

Due to the high prevalence, especially in industrialized countries, the serious effects of chronic infections and the lack of effective therapy, the development of a HCV specific chemotherapy is an important goal of pharmaceutical research and development. Such a goal, however, has been hampered by the lack of a suitable cell culture system, which enables the study of virus replication and pathogenesis in eukaryotic cells.

Due to the small amount of virus in blood or tissue, the lack of suitable cell culture systems or animal models (the chimpanzee is still the only possible experimental animal) as well as the lack of efficient systems for producing virus-like particles, it has been difficult to analyze the molecular composition of the HCV particle in-depth. The information currently available can be summarized as follows: HCV is an enveloped plus-strand RNA virus with a particle diameter of 50–60 nm and a medium density of 1.03–1.1 g/ml. It was molecularly cloned and characterized for the first time in 1989 (Choo et al., 1989, Science, 244, 359–362). The HCV-RNA has a length of approx. 9.6 kb (=9600 nucleotides), a positive polarity and comprises one open reading frame (ORF), which encodes a linear polyprotein of approx. 3010 amino acids (see Rice 1996, in Virology, B. N. Fields, D. M. Knipe, P. M. Howley, Eds. (Lippincott-Raven, Philadelphia, Pa., 1996), vol. 1, pp. 931–960; Clarke 1997, J. Gen. Virol. 78, 2397; and Bartenschlager 1997, Intervirology 40, 378 and see FIG. 1A). During the replication of the virus the polyprotein is cleaved into the mature and functionally active proteins by cellular and viral proteases.

Within the polyprotein the proteins are arranged as follows (from the amino- to the carboxy terminus): Core-E1-E2-p7-NS2-NS3-NS4A-NS4B-NS5A-NS5B. The core protein is the main component of the nucleocapsid. The glycoproteins E1 and E2 are transmembrane proteins and the main components of the viral envelope. They probably play an important role during the attachment of the virus to the host cell. These three proteins core, E1, and E2 constitute the viral particle and are therefore called structural proteins. The function of the protein p7 is still not clear. The protein NS2 is probably the catalytic domain of the NS2-3 protease, which is responsible for the processing between the proteins NS2 and NS3. The protein NS3 has two functions, one is a protease activity in the amino terminal domain, which is essential for the polyprotein processing, and the other a NTPase/helicase function in the carboxy terminal domain, which is probably important during the replication of the viral RNA. The protein NS4A is a co-factor of the NS3 protease. The function of the protein NS4B is unknown.

The open reading frame is flanked on its 5' end by a non-translated region (NTR) approx. 340 nucleotides in length, which functions as the internal ribosome entry site (IRES), and on its 3' end by a NTR approx. 230 nucleotides in length, which is most likely important for the genome replication. A 3'to NTR such as this is the object of patent application PCT/US 96/14033. The structural proteins in the amino terminal quarter of the polyprotein are cleaved by host cell signal peptidase. The non-structural proteins (NS) 2 to (NS) 5B are processed by two viral enzymes, namely the NS2-3 and the NS3/4A protease. The NS3/4A protease is required for all cleavages beyond the carboxy terminus of NS3. The function of NS4B is unknown. NS5A, a highly phosphorylated protein, seems to be responsible for the Interferon resistance of various HCV genotypes (see Enomoto et al. 1995, J. Clin. Invest. 96, 224; Enomoto et al. 1996, N. Engl. J. Med. 334, 77; Gale Jr. et al. 1997, Virology 230, 217; Kaneko et al. 1994, Biochem. Biophys. Res. Commun. 205, 320; Reed et al., 1997, J. Virol. 71, 7187), and NS5B has been identified as the RNA-dependent RNA polymerase.

First diagnostic systems have been developed from these findings, which are either based on the detection of HCV specific antibodies in patient serum or the detection of HCV specific RNA using the reverse transcription polymerase chain reaction (RT-PCR), and which are routinely used with all blood and blood products and/or according to the regulations.

Since the first description of the genome in 1989 several partial and complete sequences of the HCV have been cloned and characterized using the PCR method. A comparison of these sequences shows a high variability of the viral genome in particular in the area of the NS5B gene, which eventually resulted in the classification of 6 genotypes, which are again subdivided into the subtypes a, b, and c.

The genomic variance is not evenly distributed over the genome. The 5'to NTR and parts of the 3'to NTR are highly conserved, while certain encoded sequences vary a lot, in particular the envelope proteins E1 and E2.

The cloned and characterized partial and complete sequences of the HCV genome have also been analyzed with regard to appropriate targets for a prospective antiviral therapy. In the course of this, three viral enzymes have been discovered, which may provide a possible target. These include (1) the NS3/4A protease complex, (2) the NS3 Helicase and (3) the NS5B RNA-dependent RNA polymerase. The NS3/4A protease complex and the NS3 Helicase have already been crystallized and their three-dimensional structure determined (Kim et al., 1996, Cell, 87,343; Yem et al., 1998, Protein Science, 7, 837; Love et al., 1996, Cell, 87, 311; Kim et al., 1998, Structure, 6, 89; Yao et al., 1997, Nature Structural Biology, 4, 463, Cho et al., 1998, J. Biol. Chem., 273, 15045). it has not been successful until now with the NS5B RNA-dependent RNA polymerase.

Even though important targets for the development of a therapy for chronic HCV infection have been defined with these enzymes and even though a worldwide intensive search for suitable inhibitors is ongoing with the aid of rational drug design as well as high throughput screening, the development of a therapy has one major deficiency, namely the lack of cell culture systems or simple animal models, which allow direct, reliable identification of HCV-RNA or HCV antigens with simple methods which are common in the laboratory. The lack of these cell culture systems is also the main reason that to date the comprehension of HCV replication is still incomplete and mainly hypothetical.

Although it has been reported that a close evolutionary relationship exists between HCV and the flavi- and pestiviruses, and self-replicating RNAs have been described for these, which can be used for the replication in different cell lines with a relatively high yield, (see Khromykh et al., 1997, *J. Virol.* 71, 1497; Behrens et al., 1998, *J. Virol.* 72, 2364; Moser et al., 1998, *J. Virol.* 72, 5318), similar experiments with HCV have not been successful to date.

Although it is known from different publications that cell lines or primary cell cultures can be infected with high titre patient serum containing HCV, (Lanford et al. 1994, *Virology* 202, 606; Shimizu et al. 1993, *Proceedings of the National Academy of Sciences,* USA, 90, 6037–6041; Mizutani et al. 1996, *Journal of Virology,* 70, 7219–7223; M. Ikeda et al. 1998, *Virus Res.* 56, 157; Fournier et al. 1998, *J. Gen. Virol.* 79, 2376 and bibliographical references quoted in here; Ito et al. 1996, *Journal of General Virology,* 77, 1043–1054), these virus-infected cell lines or cell cultures do not allow the direct detection of HCV-RNA or HCV antigens. The viral RNA in these cells can not be detected in a Northern Blot (a standard method for the quantitative detection of RNA) or the viral protein in a Western Blot or with immunoprecipitation. It has only been possible to detect HCV replication with very costly and indirect methods. These disadvantageous facts show that the replication in these known virus-infected cell lines or cell cultures is insufficient. Furthermore it is known from the publications of Yoo et al. (1995, *Journal of Virology,* 69, 32–38) and of Dash et al., (1997, *American Journal of Pathology,* 151, 363–373) that hepatoma cell lines can be transfected with synthetic HCV-RNA, which are obtained through in vitro transcription of the cloned HCV genome. In both publications the authors started from the basic idea that the viral HCV genome is a plus-strand RNA functioning directly as mRNA after being transfected into the cell, permitting the synthesis of viral proteins in the course of the translation process, and so new HCV particles are (could be) formed. This viral replication, which means these newly formed HCV viruses and their RNA, have been detected through RT-PCR. However the published results of the RT-PCR carried out indicate, that the HCV replication in the described HCV transfected hepatoma cells is not particularly efficient and is not sufficient to measure the quality, let alone the quantity of the fluctuations in the replication rate after an targeted action with prospective antiviral treatments. Furthermore, Yanagi et al., Proc. Natl. Acad. Sci. USA, 96, 2291–95, 1999 reports that the highly conserved 3'to NTR is essential for the virus replication. This knowledge contradicts the statements of Yoo et al. and Dash et al., who used for their experiments only HCV genomes with shorter 3'to NTRs since they did not know the authentic 3' end of the HCV genome.

SUMMARY OF THE INVENTION

An object of the present invention is to provide a HCV cell culture system, where the viral RNA self-replicates in the transfected cells with such a high efficiency that the quality and quantity of the fluctuations in the replication rate can be measured with common methodologies usually found in the laboratory after a targeted action with virus and prospective HCV specific antivirals in particular.

The present invention is directed to a hepatitis C virus (HCV) cell culture system, which comprises mainly eukaryotic cells containing transfected HCV specific genetic material, characterized in that, the eukaryotic cells are human hepatoma cells and the transfected HCV specific genetic material is a HCV-RNA construct, which comprises the HCV specific RNA segments 5'to NTR, NS3, NS4A, NS4B, NS5A, NS5B, and 3'to NTR as well as an additional marker gene for selection (selection gene).

DETAILED DESCRIPTION OF THE INVENTION

Thus, the present invention provides a cell culture system, where the eukaryotic cells are human cells, in particular hepatoma cells, which are preferably derived from a normal hepatoma cell line, but can also be obtained from an appropriate primary cell culture, and where the transfected HCV specific genetic material is a HCV-RNA construct, which essentially comprises the HCV specific RNA segments 5'to NTR, NS3, NS4A, NS4B, NS5A, NS5B, and 3'to NTR preferably in the order mentioned as well as a minimum of one marker gene for selection (selection gene).

Here and in the following "NTR" stands for "non-translated region" and is a known and familiar term or abbreviation in the relevant art.

Here and in the following the term "HCV-RNA construct" comprises constructs, which include the complete HCV genome, as well as those, which only include a part of it, which means a HCV subgenome.

A preferred embodiment of the cell culture system according to the invention, which had proven to be worthwhile in practice, is lodged at the DSMZ, Deutsche Sammlung von Mikroorganismen und Zellkulturen GmbH (German collection of Microorganisms and Cell Cultures) in Braunschweig, Germany under the number DSM ACC2394 (laboratory name HuBl 9-13), with a date of deposit on Mar. 24, 1999.

With the cell culture system according to the invention an in vitro system is provided, where HCV-RNA is self-replicated and expressed intracellularly and in a sufficient amount, so that the quantity of the amounts of HCV-RNA as well as the HCV specific proteins can be determined with conventional and reliably precise biochemical measuring methods. The present invention thus provides a cell-based HCV replication system that is useful for, e.g., the development and testing of antiviral drugs. This test system may be used to identify potential targets for an effective HCV specific therapy and developing and evaluating HCV specific chemotherapeuticals.

The invention is based on the surprising finding that efficient replication of the HCV-RNA only occurs in cells if they have been transfected with an HCV-RNA construct, which comprises at least the 5' and the 3' non-translated regions (NTR) and the non-structural proteins (NS) 3 to 5B and additionally a marker gene for selection (selection gene). The structural genes are without great importance for replication, whereas efficient replication of the HCV-RNA apparently only occurs if the transfected cells are subject to permanent selection pressure, which is imparted by the marker gene for selection (selection gene) linked to the HCV-RNA. Consequently the marker gene (selection gene) seems on one hand to provoke the selection of those cells, where the HCV-RNA replicates productively, and it seems on the other hand to considerably increase the efficiency of the RNA replication.

An object of the invention is also a cell-free HCV-RNA construct, characterized in that it comprises the HCV specific RNA segments 5'to NTR, NS3, NS4A, NS4B, NS5A, NS5B, and 3'to NTR, preferably in the order mentioned, as well as a marker gene for selection (selection gene).

In the present context the terms 5'to NTR and NS3 and NS4A and NS4B and NS5A and NS5B and 3'to NTR comprise each nucleotide sequence, which is described in the state of the art as the nucleotide sequence for each functional segment of the HCV genome.

The HCV-RNA construct of the present invention may be used in conducting a detailed analysis of the HCV replication, pathogenesis and evolution in cell culture. The HCV specific viral RNA can specifically be created as a complete genome or subgenome in any amount, and it is possible, to manipulate the RNA construct and consequently to examine and identify the HCV functions on a genetic level.

Because all HCV enzymes identified as a main target for a therapy at the moment, namely the NS3/4A protease, the NS3 helicase and the NS5B polymerase, are included in the HCV-RNA construct according to the invention, it can be used for all relevant analyses.

An embodiment of the HCV-RNA construct, which has proven to be worthwhile in practical use, stands out by the fact that it comprises the nucleotide sequence according to the sequence protocol SEQ ID NO:1.

Further embodiments with similar good properties for practical use are characterized in that they comprise a nucleotide sequence either according to sequence protocol SEQ ID NO: 4–6 or according to sequence protocol SEQ ID NO: 7–9 or according to sequence protocol SEQ ID NO: 10–12 or according to sequence protocol SEQ ID NO: 13–15 or according to sequence protocol SEQ ID NO: 16–18 or according to sequence protocol SEQ ID NO: 19–21 or according to sequence protocol SEQ ID NO: 22–24 or according to sequence protocol SEQ ID NO: 25–27 or according to sequence protocol SEQ ID NO: 28–30 or according to sequence protocol SEQ ID NO: 31–33.

In certain embodiments, the HCV subgenomic construct comprises a 3'to NTR, which has a nucleotide sequence selected from the group of nucleotide sequences (a) to (i) listed in the following:

(a) ACGGGGAGCTAAACACTCCAGGCCAAT-AGGCCATCCTGTTTTTT TTTT-TAGCTTTTTTTTTTTCTTTTTTTTGAGAGAGA GAGTCTCACTCTGTTGC CCAGACTGGAGT (SEQ ID NO: 43)

(b) ACGGGGAGCTAAACACTCCAGGCCAAT-AGGCCATCCTGTTTTTTTTTAGTC TTTTTTTTTC TTTTTTTTGA GAGAGAGT CTCACTCTGT TGCCCAGACT GGAGC (SEQ ID NO: 44)

(c) ACGGGGAGCTAAACACTCCAGGCCAAT-AGGCCATCCTGTTTTTT TTTAATCTTT TTTTTTTCT TTTTTTTGA GAGAGAGT CTCACTCTGT TGCCCAGACT GCAGC (SEQ ID NO: 45)

(d) ACGGGGAGCTAAACACTCCAGGCCAAT-AGGCCATCCTGTTTTTTTTTTAGTC TTTTTTTTT TCTTTTTTT TGAGAGAGAG AGTCTCACTC TGTTGCCCAG ACTGGAGT (SEQ ID NO: 46)

(e) ACGGGGAGCTAAACACTCCAGGCCAAT-AGGCCATCCTGTTTTTT TTTTTAGTCT TTTTTTTTT TCTTTTTTTT TGAGAGAGAG AGTCTCACTC TGTTGCCCAG ACTGGAGT (SEQ ID NO: 47)

(f) ACGGGGAGCTAAACACTCCAGGCCAAT-AGGCCATCCTGTTTTTTTTTTTAGTCT TTTTTTTTT TCTTTTTTTT TTGAGAGAGA GAGTCTCACT CTGTTGCCCA GACTGGAGT (SEQ ID NO: 48)

(g) ACGGGGAGCTAAACACTCCAGGCCAAT-AGGCCATCCTGTTTTTTTTTTAGTCT TTTTTTTTT CTTTTTTTT GAGAGAGAGA GTCT-CACTCT GTTGCCCAGA CTGGAGT (SEQ ID NO: 49)

(h) ACGGGGAGCTAAACACTCCAGGCCAAT-AGGCCATCCTGTTTTTTTTTTTTAAT CTTTTTTTTT TTTTTCCTTT TTTTGAGAGA GAGAGTCTCA CTCTGTTGCC CAGACTGGAG T (SEQ ID NO: 50).

(i) ACGGGGAGCTAAACACTCCAGGCCAAT-AGGCCATCCTGTTTTTTTTTTTAATC TTTTTTTTTT TTTTCTTTTT TTTTTGAGAG AGAGAGTCTC ACTCTGTTGC CCAGACTGGAGT(SEQ ID NO: 51)

The marker gene for selection (selection gene) included in the HCV-RNA constructs according to the invention is preferably a resistance gene, in particular an antibiotic resistance gene.

This has the advantage that the cells transfected with this construct can easily be selected from the non-transfected cells by adding for example the appropriate antibiotic to the cell culture medium in the case of an antibiotic resistance gene.

In the present context 'antibiotic' means any substance, which impedes the non-transfected host cells or the cells, where the HCV-RNA is not replicating efficiently, continuing to live or grow, especially the cell poison Puromycin, Hygromycin, Zeocin, Bleomycin or Blasticidin.

A preferred marker gene for selection (selection gene) and resistance gene, which has proven to be worthwhile in practice, is the neomycin phosphotransferase gene.

An alternative for the antibiotic resistance genes is for example the thymidine kinase gene, which can be used to carry out a HAT selection.

The marker gene for selection (selection gene), the preferred resistance gene and the most preferred antibiotic resistance gene is preferably positioned in the HCV-RNA construct after the HCV 5'to NTR, which means downstream from the 5'to NTR and upstream from the HCV reading frame. However, an insertion in the area of the 3'to NTR or another site of the HCV genome or subgenome, for example within the polyprotein, is also contemplated.

In another embodiment of the HCV-RNA construct according to the invention the marker gene for selection (selection gene), in particular an antibiotic resistance gene, is linked to the HCV-RNA or HCV genomic or subgenomic sequence via a ribozyme or a recognition site for a ribozyme.

This has the advantage, that after the selection of the cells, in which the HCV-RNA is replicating productively, the resistance gene in the obtained cell clones can be separated from the HCV subgenomic sequence through a ribozyme-dependent cleavage, namely by activating the inserted ribozyme or in the case of a construct with a recognition site for a ribozyme, by transfecting the ribozyme into the cells (for example through the transfection of a ribozyme construct or infection with a viral expression vector, into which the appropriate ribozyme has been inserted). By this means an authentic HCV genomic construct can be obtained without a resistance gene, which can then form authentic infectious virus particles.

Another preferred embodiment of the HCV-RNA construct according to the invention is characterized in that the construct has at least one integrated reporter gene.

In the following a reporter gene means any gene, whose presence can be easily detected with, in general, simple biochemical or also histochemical methods after being transferred into a target organism, which means a gene, that encodes for a protein, which can be easily and reliably detected and quantified in small amounts with the common measuring methods in the laboratory.

This variation of the HCV-RNA construct has the advantage that the extent of the replication of this construct can be easily and quickly measured with the methods common in the laboratory using the reporter gene product.

The reporter gene is preferably a gene from the group of the luciferase genes, the CAT gene (chloramphenicol acetyl transferase gene), the lacZ gene (beta galactosidase gene), the GFP gene (green fluorescence protein gene), the GUS gene (glucuronidase gene) or the SEAP gene (secreted alkaline phosphatase gene). This reporter gene and its products, namely the relevant reporter proteins, can be detected for example using fluorescence, chemiluminescence, colorimetric measurements or by means of immunological methods (for example ELISA).

A surrogate marker gene can also be considered as a reporter gene. In this context it includes those genes, which encode for cellular proteins, nucleic acids or generally for those functions, which are subject to variation depending on the replication of the virus, and which consequently are either suppressed or activated in the cells, in which the HCV or the HCV-RNA construct multiplies. This means, the suppression or activation of this function is a surrogate marker for the replication of the virus or the replication of the HCV-RNA construct.

The positions of the reporter genes and the marker gene for selection (selection gene) can be selected in such a way, that a fusion protein made from both genetic products will be expressed. This has the advantage that these two genes can be arranged in such a way in the HCV-RNA construct that their two expressed proteins are fused via a recognition sequence for a protease (for example ubiquitin) or via a self-cleaving peptide (for example the 2A protein of the Picornaviruses) at first and will be separated proteolytically later.

These two positions might as well lie apart from each other in such way, that both genetic products are separately expressed (for example in the order: marker or resistance gene—internal ribosome binding site—reporter gene).

In the case of the reporter gene one embodiment has proven to be particularly worthwhile, where the reporter gene is cloned into the open reading frame of the HCV genome or subgenome in such a way that it will only be transferred to an active form after proteolytic processing.

The cell culture system according to the invention can be used for various purposes in each of its embodiments. These include:

- The detection of antiviral substances. This can include for example: organic compounds, which interfere directly or indirectly with viral growth (for example inhibitors of the viral proteases, the NS3 helicase, the NS5B RNA-dependent RNA polymerase), antisense oligonucleotides, which will hybridize to any target sequence in the HCV-RNA construct (for example the 5'to NTR) and will have an direct or indirect influence on the virus growth for example due to a reduction of translation of the HCV polyprotein or ribozymes, which cleave any HCV-RNA sequence and consequently impair virus replication.
- The evaluation of any type of antiviral substances in the cell culture. These substances can be detected on the isolated purified enzyme for example with 'rational drug design' or 'high-throughput screening'. Evaluation means mainly the determination of the inhibitory features of the respective substance as well as its mode of action.
- The identification of new targets of viral or cellular origin for a HCV specific antiviral therapy. If for example a cellular protein is essential for viral replication, the viral replication can also be influenced by inhibiting this cellular protein. The system according to the invention also enables the detection of these auxiliary factors.
- The determination of drug resistance. It can be assumed that resistance to therapy occurs due to the high mutation rate of the HCV genome. This resistance, which is very important for the clinical approval of a substance, can be detected with the cell culture system according to the invention. Cell lines, in which the HCV-RNA construct or the HCV genome or subgenome replicates, are incubated with increasing concentrations of the relevant substance and the replication of the viral RNA is either determined by means of an introduced reporter gene or through the qualitative or quantitative detection of the viral nucleic acids or proteins. Resistance is given if no or a reduced inhibition of the replication can be observed with the normal concentration of the active substance. The nucleotide and amino acid replacements responsible for the therapy resistance can be determined by recloning the HCV-RNA (for example by the means of RT-PCR) and sequence analysis. By cloning the relevant replacement(s) into the original construct its causality for the resistance to therapy can be proven.
- The production of authentic virus proteins (antigens) for the development and/or evaluation of diagnostics. The cell culture system according to the invention also allows the expression of HCV antigens in cell cultures. In principle these antigens can be used as the basis for diagnostic detection methods.
- The production of HCV viruses and virus-like particles, in particular for the development or production of therapeutics and vaccines as well as for diagnostic purposes. Especially cell culture adapted complete HCV genomes, which could be produced by using the cell culture system according to the invention, are able to replicate in cell culture with high efficiency. These genomes have the complete functions of HCV and in consequence they are able to produce infectious viruses.

The HCV-RNA construct according to the invention by itself can also be used for various purposes in all its embodiments. This includes first of all:

- The construction of attenuated hepatitis C viruses or HCV-like particles and their production in cell cultures:
  - Attenuated HCV or HCV-like particles can be created by accidental or purposefully introduced mutations, such as point mutations, deletions or insertions, which means viruses or virus-like particles with complete ability to replicate, but reduced or missing pathogenicity. These attenuated HCV or HCV-like particles can be used in particular as vaccine.

The construction of HCV-RNA constructs with integrated foreign genes, used for example as liver cell specific vector in gene therapy. Due to the distinctive liver cell tropism of the HCV and the possibility of replacing parts of the genome by heterologous sequences, HCV-RNA constructs can be produced, where for example the structural proteins can be replaced by a therapeutically effective gene. The HCV-RNA construct obtained in this way is introduced into cells preferably by means of transfection, which express the missing HCV functions, for example the structural proteins, in a constitutive or inducible way. Virus particles, carrying the HCV-RNA construct, can be created by means of this method known to the expert under the term 'transcomplementation'. The particles obtained can preferably be used for the infection of liver cells. Within these the therapeutically effective foreign gene will be expressed and will consequently develop its therapeutic effect.

The detection of permissive cells, which means cells, in which a productive virus growth occurs. For this purpose either one of the HCV-RNA genomic constructs previously mentioned, which is able to form complete infectious viruses, or one of the HCV subgenomes previously mentioned, which according to the previously mentioned example will be transfected in a cell line first, which expresses the missing functions in a constitutive or inducible way, is used. In each case virus particles are created, which carry a resistance and/or reporter gene apart from the HCV sequence. In order to detect cells, where the HCV is able to replicate, these cells are infected with viruses generated in this way and subject to an antibiotic selection or they are examined depending on the HCV-RNA construct by means of determining the presence of the expression of the reporter gene. Because an antibiotic resistance or reporter gene expression can only be established, when HCV-RNA construct replicates, the cells detected in this way must be permissive. Almost any cell line or primary cell culture can be tested in regard to the permissivity and detected in this way.

The cell culture system according to the invention also permits targeted discovery of HCV-RNA constructs for which there is an increase in the efficiency of replication due to mutations. This occurs either by chance, in the context of HCV-RNA replication, or by targeted introduction into the construct. These mutations, leading to a change in the replication of the HCV-RNA construct, are known as adaptive mutations. The invention therefore also includes a method for obtaining cell culture adapted mutants of a HCV-RNA construct according to the invention following the above description, in which the mutants have increased replication efficiency compared to the original HCV-RNA construct. It further includes a method for the production of mutants of a HCV-RNA full-length genome or of a HCV-RNA subgenome or of any HCV-RNA construct with increased replication efficiency compared to the original HCV-RNA full-length genome or subgenome or HCV-RNA construct, as well as cell culture adapted mutants of HCV-RNA constructs, HCV-RNA full-length genomes and HCV subgenomes with increased replication efficiency compared to the original constructs, subgenomes or full-length genomes.

The method according to the invention for the production of cell culture adapted mutants of a HCV-RNA construct according to the invention, in which the mutants have increased replication efficiency compared to the HCV-RNA construct, is characterized in that a cell culture system according to the present invention, in which the transfected HCV specific genetic material is a HCV-RNA construct with a selection gene, is cultivated on/in the selection medium corresponding to the selection gene, that the cultivated cell clones are collected and that the HCV-RNA construct is isolated from these cell clones.

In certain embodiments, the isolated HCV-RNA constructs are passaged at least one more time, that is they are transfected in cells of a cell culture system according to the present invention to obtain the cell culture system according to the present invention, in which the transfected HCV specific genetic material is the isolated HCV-RNA construct with a selection gene, is cultivated on/in the selection medium corresponding to the selection gene, the cultivated cell clones are collected and the HCV-RNA constructs are thus isolated.

Using this process variation, the quantity of adaptive mutations and hence the degree of replication efficiency in the relevant HCV-RNA constructs can be increased even further.

The method according to the invention for the production of mutants of a HCV-RNA full-length genome or of a HCV-RNA subgenome or of any HCV-RNA construct with increased replication efficiency compared to the original HCV-RNA full-length genome or subgenome or HCV-RNA construct, has the following features. Using one of the two production methods presented above, a cell culture adapted mutant of a HCV-RNA construct is produced, isolated from the cells, cloned using the methods known in the art and sequenced. By comparing with the nucleotide and amino acid sequence of the original HCV-RNA construct, the type, number and position of the mutations is determined. These mutations are then introduced into an (isolated) HCV subgenome or full-length genome or any HCV-RNA construct, either by site-directed mutagenesis, or by exchange of DNA fragments containing the relevant mutations.

A test can be carried out to determine or verify which mutations actually are responsible for an alteration of replication efficiency, particularly an increase in replication. In this test the corresponding nucleotide and/or amino acid changes are introduced into the original HCV-RNA construct and the modified construct is then transfected in cell culture. If the introduced mutation actually leads to an increase in replication, then for a HCV-RNA construct with a selectable marker gene, the number of resistant cell clones in the artificially mutated construct should be noticeably higher compared to the untreated construct.

In the case of a construct with a reporter gene, the activity or quantity of the reporter should be noticeably higher for the artificially mutated construct compared to the untreated one.

The cell culture adapted HCV-RNA constructs with high replication efficiency according to the invention are characterized in that, through nucleotide or amino acid exchanges, they are derivable from a HCV-RNA construct of the present invention, and that they are obtainable using one of the two production processes presented above.

These cell culture adapted HCV-RNA constructs can be used to produce any HCV-RNA constructs or HCV full-length or subgenomes with increased replication efficiency. Both constructs with a selectable resistance gene and constructs without one or with a non-selectable reporter gene (e.g. luciferase) can be produced in this way, since replication of cell culture adapted HCV-RNA constructs can also be demonstrated in non-selected cells due to their high replication efficiency.

The cell culture adapted mutants of a HCV-RNA construct or HCV-RNA full-length genome or HCV subgenome with high replication efficiency compared to the original HCV-RNA construct or the original HCV full-length genome are characterized in that they are obtainable by a method in which the type and number of mutations in a cell culture adapted HCV-RNA construct are determined through sequence analysis and sequence comparison and these mutations are introduced into a HCV-RNA construct, particularly a HCV-RNA construct according to the present invention, or into an (isolated) HCV-RNA full-length genome, either by site-directed mutagenesis, or by exchange of DNA fragments containing the relevant mutations.

A group of preferred HCV-RNA constructs, HCV full-length genomes and HCV subgenomes with high and very high replication efficiency, which are consequently highly suitable for practical use is characterized in that it contains one, several or all of the amino acid or nucleic acid exchanges listed in table 3 and/or one or several of the following amino acid exchanges: 1283 arg→gly , 1383 glu→ala , 1577 lys→arg , 1609 lys→glu , 1936 pro→ser, 2163 glu→gly, 2330 lys→glu, 2442 ile→val. (The numbers refer to the amino acid positions of the polyprotein of the HCV isolate con1, see Table 1).

Special Features of the Nucleotide Sequences
According to the Sequence Listings

SEQ ID-NO: 1–3
Name: I389/Core-3'/wt
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame
4. 1813–10842: HCV Polyprotein from Core up to nonstructural protein 5B
5. 1813–2385: HCV Core Protein; structural protein
6. 2386–2961: envelope protein 1 (E1); structural protein
7. 2962–4050: envelope protein 2 (E2); structural protein
8. 4051–4239: Protein p7
9. 4240–4890: nonstructural protein 2 (NS2); HCV NS2-3 Protease
10. 4891–6783: nonstructural protein 3 (NS3); HCV NS3 Protease/Helicase
11. 6784–6945: nonstructural protein 4A (NS4A); NS3 Protease cofactor
12. 6946–7728: nonstructural protein 4B (NS4B)
13. 7729–9069: nonstructural protein 5A (NS5A)
14. 9070–10842: nonstructural protein 5B (NS5B); RNA-dependent RNA-polymerase
15. 10846–11076: HCV 3' non-translated region SEQ ID-NO: 4–6
Name: I337/NS2-3'/wt
Composition (Nucleotide positions):

1. 1–341: HCV 5' non-translated region
2. 342–1181: HCV Core Protein-Neomycin Phosphotransferase fusion protein; selectable Marker
3. 1190–1800: internal ribosome entry site from encephalomyokarditis virus; directs translation of the downstream located HCV open reading frame
4. 1801–8403: HCV Polyprotein from nonstructural protein 2 up to nonstructural protein 5B
5. 1801–2451: nonstructural protein 2 (NS2); HCV NS2-3 Protease
6. 2452–4344: nonstructural protein 3 (NS3); HCV NS3 Protease/Helicase
7. 4345–4506: nonstructural protein 4A (NS4A); NS3 Protease cofactor
8. 4507–5289: nonstructural protein 4B (NS4B)
9. 5290–6630: nonstructural protein 5A (NS5A)
10. 6631–8403: nonstructural protein 5B (NS5B); RNA-dependent RNA-polymerase
11. 8407–8637: HCV 3' non-translated region SEQ ID-NO: 7–9
Name: I389/NS3-3'/wt
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame
4. 1813–7767: HCV Polyprotein from nonstructural protein 3 up to nonstructural protein 5B
5. 1813–3708: nonstructural protein 3 (NS3); HCV NS3 Protease/Helicase
6. 3709–3870: Nonstructural protein 4A (NS4A); NS3 Protease Cofactor
7. 3871–4653: Nonstructural protein 4B (NS4B)
8. 4654–5994: Nonstructural protein 5A (NS5A)
9. 5995–7767: Nonstructural protein 5B (NS5B); RNA-dependent RNA-Polymerase
10. 7771–8001: HCV 3' non-translated Region SEQ ID-NO: 10–12
Name: I337/NS3-3'/wt
Composition (Nucleotide positions):

1. 1–341: HCV 5' non-translated region
2. 342–1181: HCV Core Protein-Neomycin Phosphotransferase fusion protein; selectable Marker
3. 1190–1800: internal ribosome entry site from encephalomyokarditis virus; directs translation of the downstream located HCV open reading frame
4. 1801–7758: HCV Polyprotein from Nonstructural protein 3 up to Nonstructural protein 5B
5. 1801–3696: Nonstructural protein 3 (NS3); HCV NS3 Protease/Helicase
6. 3697–3858: Nonstructural protein 4A (NS4A); NS3 Protease Cofactor
7. 3859–4641: Nonstructural protein 4B (NS4B)
8. 4642–5982: Nonstructural protein 5A (NS5A)
9. 5983–7755: Nonstructural protein 5B (NS5B); RNA-dependent RNA-Polymerase
10. 7759–7989: HCV 3' non-translated Region SEQ ID-NO: 13–15
Name: I389/NS2-3'/wt
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame 4. 1813–8418: HCV Polyprotein from Nonstructural protein 2 up to Nonstructural protein 5B
5. 1813–2463: Nonstructural protein 2 (NS2); HCV NS2-3 Protease
6. 2464–4356: Nonstructural protein 3 (NS3); HCV NS3 Protease/Helicase
7. 4357–4518: Nonstructural protein 4A (NS4A); NS3 Protease Cofactor
8. 4519–5301: Nonstructural protein 4B (NS4B)
9. 5302–6642: Nonstructural protein SA (NS5A)
10. 6643–8415: Nonstructural protein 5B (NS5B); RNA-dependent RNA-Polymerase
11. 8419–8649: HCV 3' non-translated Region SEQ ID-NO: 16–18
Name: I389/NS3-3'/9-13F
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame
4. 1813–7767: HCV Polyprotein from Nonstructural protein 3 up to Nonstructural protein 5B of the cell culture-adapted mutant 9-13F
5. 1813–3708: Nonstructural protein 3 (NS3); HCV NS3 Protease/Helicase
6. 3709–3870: Nonstructural protein 4A (NS4A); NS3, Protease Cofactor
7. 3871–4653: Nonstructural protein 4B (NS4B)
8. 4654–5994: Nonstructural protein 5A (NS5A)
9. 5995–7767: Nonstructural protein 5B (NS5B); RNA-dependent RNA-Polymerase
10. 7771–8001: HCV 3' non-translated Region SEQ ID-NO: 19–21
Name: I389/Core-3'/9-13F
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame
4. 1813–10842: HCV Polyprotein from Core up to Nonstructural protein 5B of the cell culture-adapted mutant 9-13F
5. 1813–2385: HCV Core Protein; structural protein
6. 2386–2961: envelope protein 1 (E1); structural protein
7. 2962–4050: envelope protein 2 (E2); structural protein
8. 4051–4239: Protein p7
9. 4240–4890: Nonstructural protein 2 (NS2); HCV NS2-3 Protease
10. 4891–6783: Nonstructural protein 3 (NS3); HCV NS3 Protease/Helicase
11. 6784–6945: Nonstructural protein 4A (NS4A); NS3 Protease Cofactor
12. 6946–7728: Nonstructural protein 4B (NS4B)
13. 7729–9069: Nonstructural protein SA (NS5A)
14. 9070–10842: Nonstructural protein 5B (NS5B); RNA-dependent RNA-Polymerase
15. 10846–11076: HCV 3' non-translated Region SEQ ID-NO: 22–24
Name: I389/NS3-3'/5.1
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame
4. 1813–7767: HCV Polyprotein from Nonstructural protein 3 up to Nonstructural protein 5B of the cell culture-adapted mutant 5.1
5. 1813–3708: Nonstructural protein 3 (NS3); HCV NS3 Protease/Helicase
6. 3709–3870: Nonstructural protein 4A (NS4A); NS3 Protease Cofactor
7. 3871–4653: Nonstructural protein 4B (NS4B)
8. 4654–5994: Nonstructural protein SA (NS5A)
9. 5995–7767: Nonstructural protein 5B (NS5B); RNA-dependent RNA-Polymerase
10. 7771–8001: HCV 3' non-translated Region SEQ ID-NO: 25–27
Name: I389/Core-3'/5.1
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame
4. 1813–10842: HCV Polyprotein from Core up to Nonstructural protein 5B of the cell culture-adapted mutant 5.1
5. 1813–2385: HCV Core Protein; structural protein
6. 2386–2961: envelope protein 1 (E1); structural protein
7. 2962–4050: envelope protein 2 (E2); structural protein
8. 4051–4239: Protein p7
9. 4240–4890: Nonstructural protein 2 (NS2); HCV NS2-3 Protease
10. 4891–6783: Nonstructural protein 3 (NS3); HCV NS3 Protease/Helicase
11. 6784–6945: Nonstructural protein:4A (NS4A); NS3 Protease Cofactor
12. 6946–7728: Nonstructural protein 4B (NS4B)
13. 7729–9069: Nonstructural protein 5A (NS5A)
14. 9070–10842: Nonstructural protein 5B (NS5B); RNA-dependent RNA-Polymerase
15. 10846–11076: HCV 3' non-translated Region SEQ ID-NO: 28–30
Name: I389/NS3-3'/19
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame
4. 1813–7767: HCV Polyprotein from Nonstructural protein 3 up to Nonstructural protein 5B of the cell culture-adapted mutant 19

5. 1813–3708: Nonstructural protein 3 (NS3); HCV NS3 Protease/Helicase
6. 3709–3870: Nonstructural protein 4A (NS4A); NS3 Protease Cofactor
7. 3871–4653: Nonstructural protein 4B (NS4B)
8. 4654–5994: Nonstructural protein 5A (NS5A)
9. 5995–7767: Nonstructural protein 5B (NS5B); RNA-dependent RNA-Polymerase
10. 7771–8001: HCV 3' non-translated Region SEQ ID-NO: 31–33
Name: I389/Core-3'/19
Composition (Nucleotide positions):

1. 1–341: HCV 5' non-translated region
2. 342–1193: HCV Core Protein-Neomycin Phosphotransferase fusion protein; selectable Marker
3. 1202–1812: internal ribosome entry site from encephalomyokarditis virus; directs translation of the downstream located HCV open reading frame
4. 1813–10842: HCV Polyprotein from Core up to Nonstructural protein 5B of the cell culture-adapted mutant 19
5. 1813–2385: HCV Core Protein; structural protein
6. 2386–2961: envelope protein 1 (E1); structural protein
7. 2962–4050: envelope protein 2 (E2); structural protein
8. 4051–4239: Protein p7
9. 4240–4890: Nonstructural protein 2 (NS2); HCV NS2-3 Protease
10. 4891–6783: Nonstructural protein 3 (NS3); HCV NS3 Protease/Helicase
11. 6784–6945: Nonstructural protein 4A (NS4A); NS3 Protease Cofactor
12. 6946–7728: Nonstructural protein 4B (NS4B)
13. 7729–9069: Nonstructural protein 5A (NS5A)
14. 9070–10842: Nonstructural protein 5B (NS5B); RNA-dependent RNA-Polymerase
15. 10846–11076: HCV 3' non-translated Region

Figure 1:
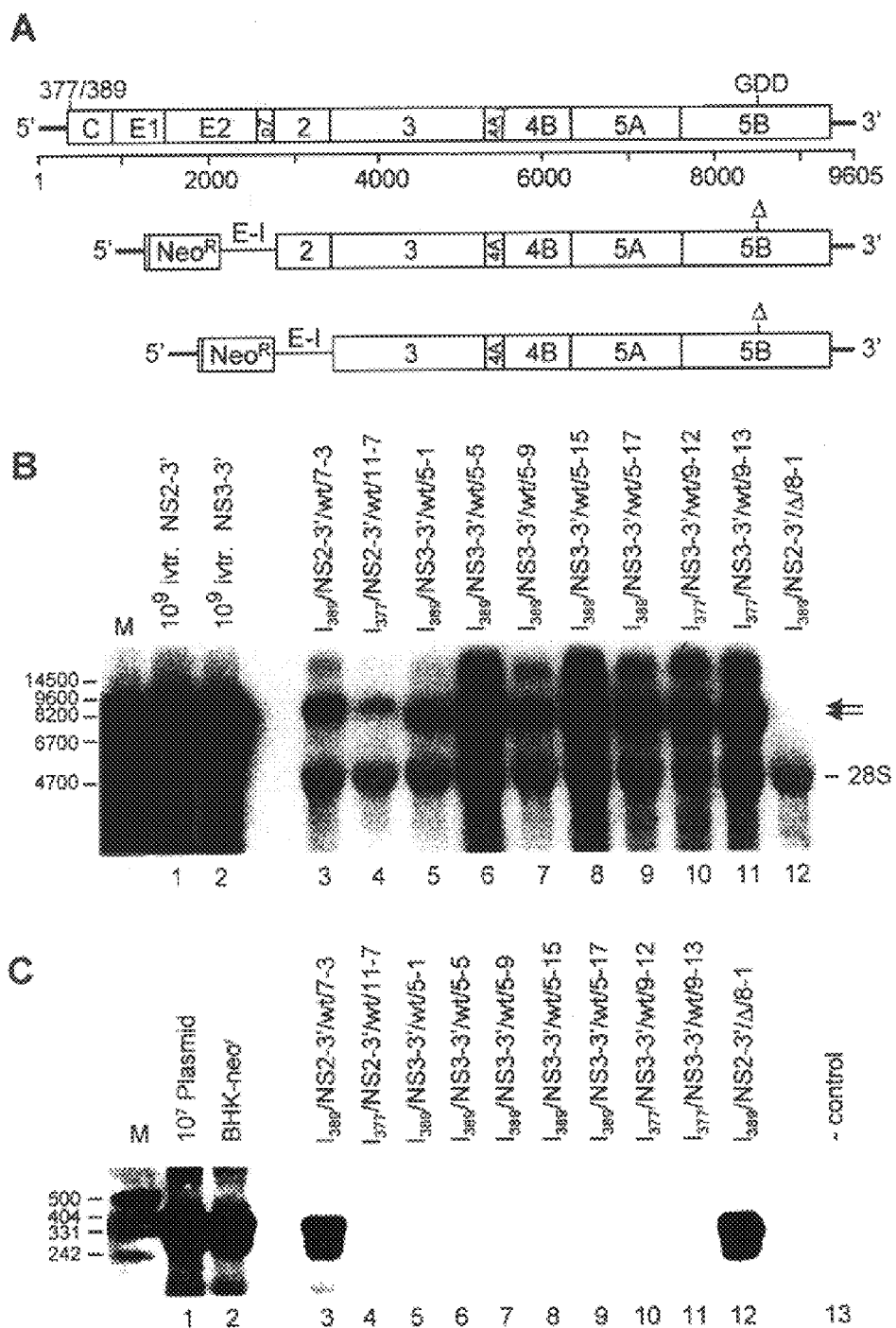
FIG. 1A: The structure of a HCV-RNA construct according to the invention

On the top a diagram of the structure of the complete parental HCV genome is given with the positions of the genes for the cleavage products core, E1, E2, p7, NS2, NS3, NS4A, NS4B, NS5A, and NS5B within the polyprotein, and the 5' and 3' non-translated regions (5'to NTR and 3'to NTR)—shown as a thick horizontal line—, and with the two positions selected for the creation of the subgenomic constructs, namely the position of the 'GDD catalytic domain' of the NS5B RNA polymerase (GDD) and the position of the 3' end of the HCV-IRES (nucleotide positions 1 to 377 and 1 to 389)—drawn above the diagram of the genome. The numbers below the diagram of the genome indicate the respective nucleotide positions.

Diagrams of the structure of two modified HCV-RNA constructs (subgenome) according to the invention are shown below, consisting of the 5' HCV-IRES, the neomycin phosphotransferase gene (Neo$^R$), the EMCV-IRES (E-I) and the HCV sequences of NS2 or NS3 up to the authentic 3' end. The position of the 10-amino acid deletion comprising the NS5B polymerase GDD motive is marked with a triangle (Δ).

FIG. 1B: The result of a denaturing formaldehyde-agarose gel electrophoresis for the detection of replicating plus-strand RNA in transfected subpassaged Huh 7 cell clones.

The positions of HCV specific RNAs (arrows) and the 28S rRNA are specified to the right of lane 12, the size (number of nucleotides) of the RNA marker (M) is specified to the left of lane 1.

FIG. 1C: The result,of a PCR test with subsequent Southern Blot to demonstrate the absence of integrated replicon DNA in most of the selected cell clones.

The lanes 1 and 2 show the positive control, lane 13 the negative control. The figures to the left of lane 1 indicate the size of the nucleotide marker molecules.

Figure 2:
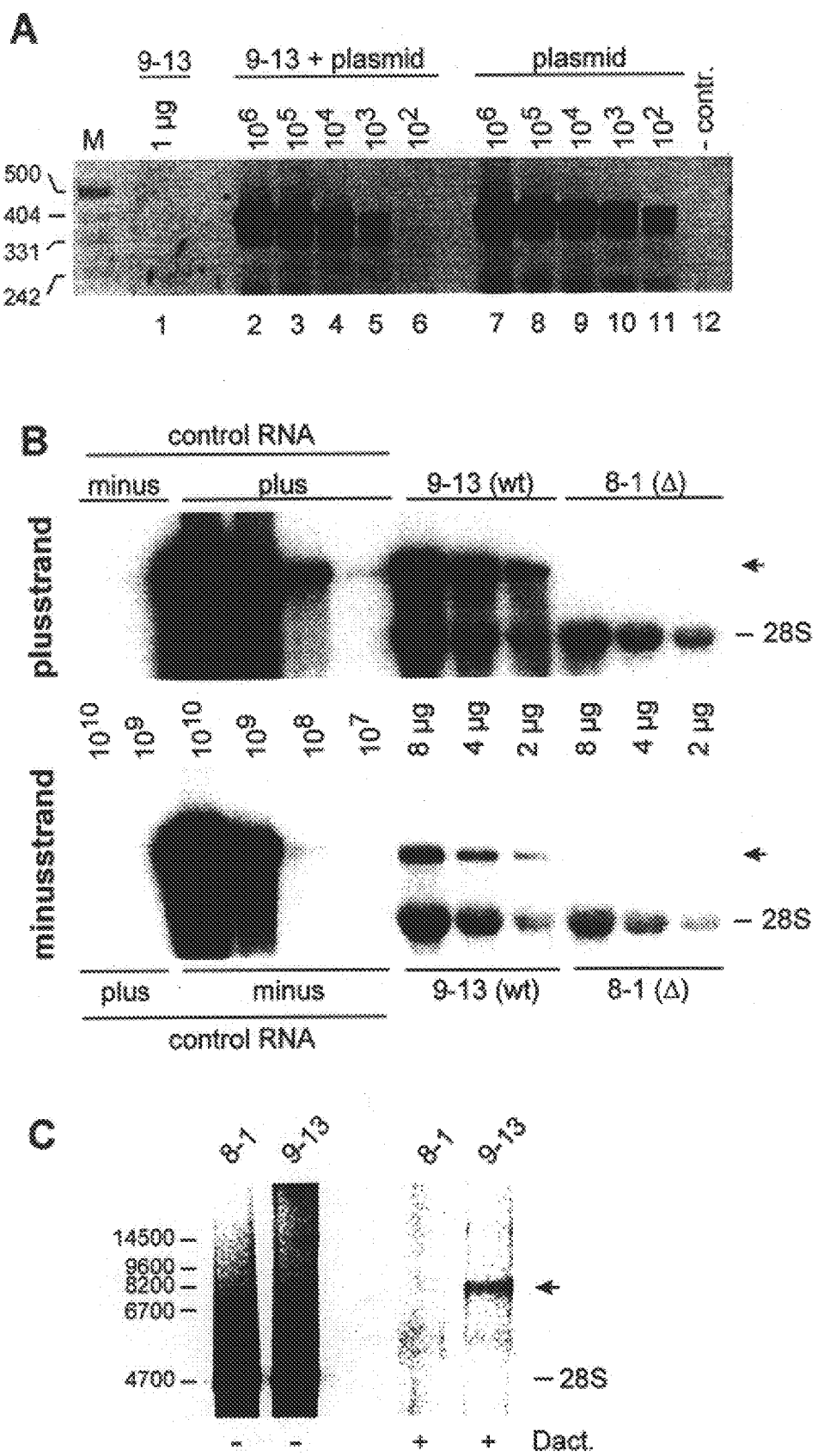

FIG. 2A: The result of a PCR test with subsequent Southern Blot for the detection of the sensitive exclusion of integrated replicon DNA (plasmid molecule $I_{377}$/NS3-3'/wt) in a cell clone containing a HCV-RNA construct (9-13).

The lanes 7 to 11 represent the result of a titration of DNA molecules of the construct $I_{377}$/NS3-3'/wt without addition of total DNA of the cell clone 9-13, and the lanes 2–6 represent the result obtained with the same plasmid molecules with the addition of 1 μg 9-13 DNA each prior to the PCR (for the purpose of excluding an inhibitor of the PCR in the DNA preparation). Lane 13 represents the negative control (PCR without DNA template) Lane 1 shows the result, which was achieved with one μg total DNA of the cell clone 9-13.

FIG. 2B: The result of a Northern Blot test to quantify the amounts of HCV plus- and minus-strand RNA.

The arrows mark the positions of replicon RNA.
The "plus" and "minus" details indicate the positive (plus) and negative (minus) polarity of the RNA controls, which have been applied to the gel. "Minus-strand" and "Plus-strand" indicate the specificity of the radioactive RNA probes.

FIG. 2C: The result of a formaldehyde-agarose gel electrophoresis after radioactive labeling of the intracellular replicated HCV-RNA to demonstrate the resistance of HCV-RNA replication to dactinomycin.

Figure 3:
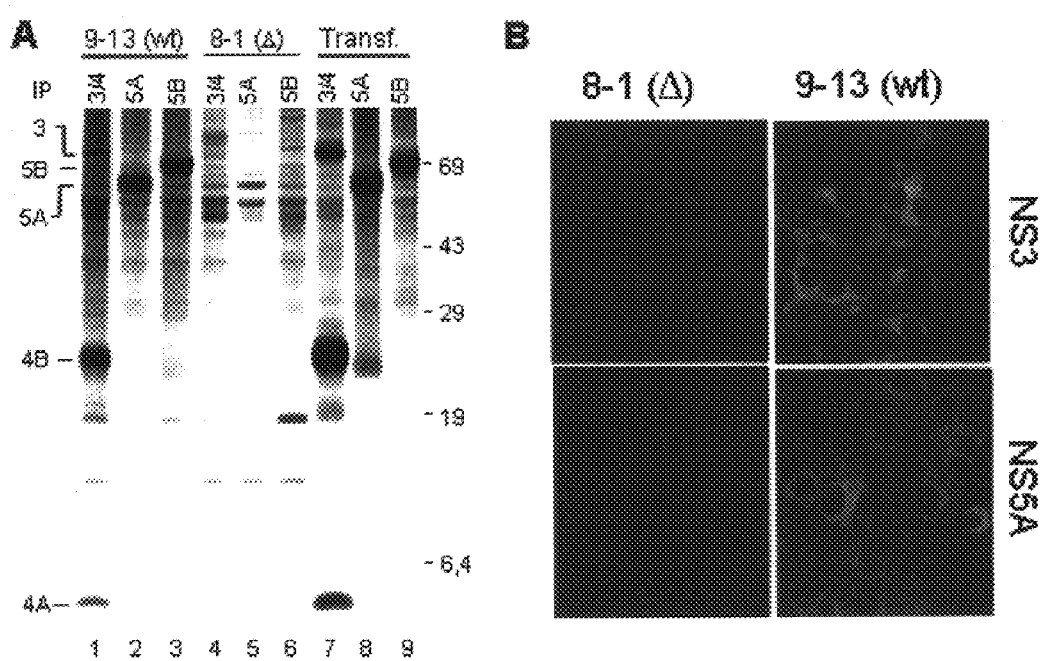

FIG. 3A: The detection of HCV specific antigens in the selected cell clones by means of immunoprecipitation after metabolic radioactive labeling.

The lanes 7–9 represent authentic size marker (which have been obtained in Huh 7 cells after the transient expression of a HCV-RNA construct); identified HCV proteins are labeled on the left edge of lane 1, the molecular weights (in Kilodalton) are specified to the right of lane 9.

FIG. 3B: Results of an immunofluorescence test to establish the subcellular localization of HCV antigens.

FIG. 4: Diagram of the structure of a selectable HCV-RNA construct according to the invention (complete genome) consisting of the 5' HCV-IRES, the neomycin phosphotransferase gene (NeoR), a heterologous IRES element, for example from the encephalomyocarditis virus (E-I), the complete HCV open reading frame and the authentic 3'to NTR.

FIG. 5: Diagram of the structure of HCV-RNA constructs with inserted antibiotic resistance gene (A) within the nucleotide sequence encoding the polyprotein (monocistronic RNA construct), and (B) within the 3'to NTR (bicistronic RNA construct).

FIG. 6: Diagram of the structure of HCV-RNA constructs with inserted reporter genes (A) as part of a HCV replicon from NS3 to NS5B,—in the end the reporter protein is cleaved by viral or cellular proteases out of the polyprotein or the marker gene for selection (selection gene) or the resistance gene are transfected into the cells through co-transfection—, (B) as part of a fusion gene composed of a resistance and reporter gene (for example for the neomycin phosphotransferase and green fluorescent protein), (C) as part of a replicon composed of a resistance and reporter gene (for example the neomycin phosphotransferase and green fluorescent protein) bound via a nucleotide sequence, which encodes for an amino acid sequence (area with hatches), which can be cleaved by a protease or has a self-cleaving (autocatalytic) activity, (D) as independent gene (in this case the green fluorescent protein), which is expressed from its own internal ribosome binding site (IRES);—the resistance gene (in this case the neomycin phosphotransferase gene) is also expressed from its own internal ribosome binding site (IRES) (polycistronic construct).

Figure 7:
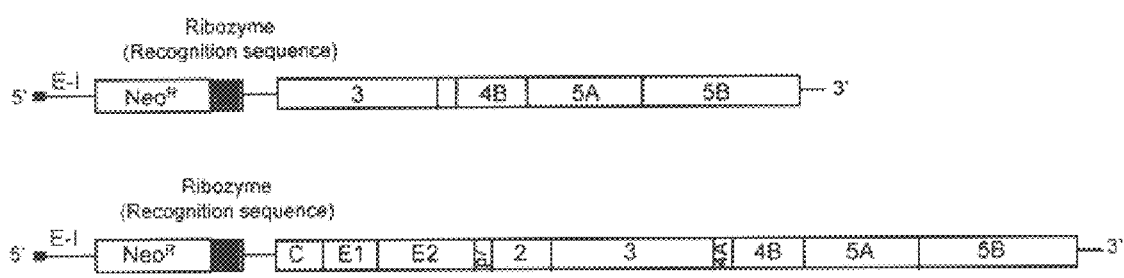

FIG. 7: Diagram of the structure of a HCV-RNA construct, where the resistance gene is linked to the HCV-RNA sequence via a ribozyme or a recognition site for a ribozyme.

The thick lines illustrate the HCV 5' and 3'to NTRs, E-I is a heterologous internal ribosome binding site, which is required for the expression of the resistance gene, and the grey square illustrates the ribozyme or a recognition site for a ribozyme.

Figure 8:

FIG. 8: Diagram of the structure of a HCV-RNA construct with resistance gene and integrated foreign gene.

Figure 9:
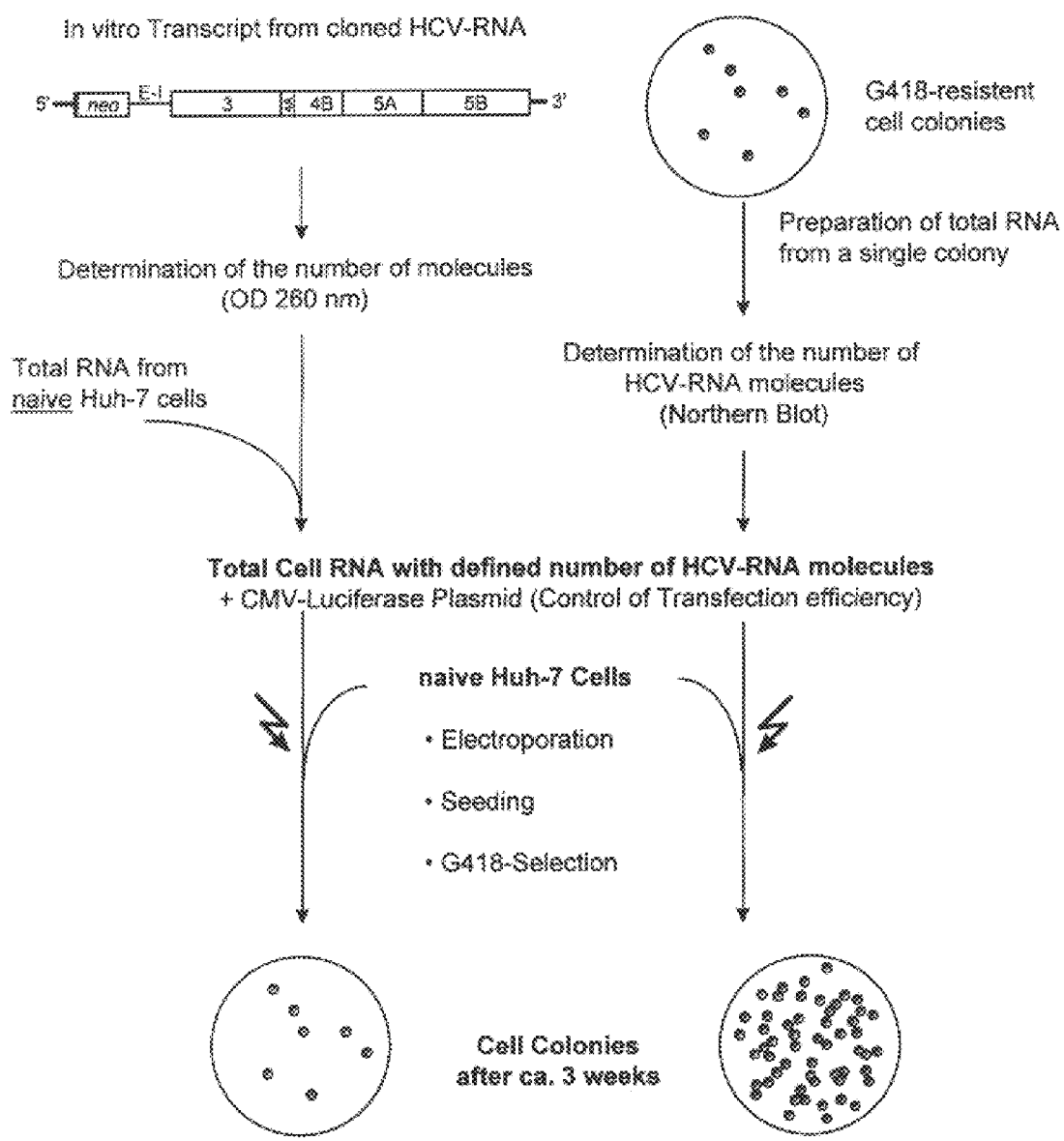

FIG. 9: Method for comparing the specific infectivity (expressed as number of cell colonies obtained) of total RNA against in vitro transcripts. HCV-RNA is generated by in vitro transcription of a corresponding RNA construct and quantified by measurement of the optical density at 260 nm (OD 260 nm). A defined number of these molecules is mixed with a specified amount of total RNA from naive Huh-7 cells and this mixture is transfected into naive Huh-7 cells with the aid of electroporation. At the same time the total RNA of a cell clone, produced by the method described in FIG. 1, is isolated using a known state of the art method and the amount of HCV-RNA contained therein is determined by means of Northern Blot using a HCV specific RNA probe and subsequent quantification via phosphoimaging. A defined amount of this total RNA is analogously transfected in naive Huh-7 cells. These cells from both the cultures are then subjected to a G418 selection and the number of colonies created is determined by counting after fixing and staining with Coomassie Brilliant Blue. For the determination of transfection efficiency 1 µg of a plasmid allowing the expression of luciferase is added to each transfection culture. An aliquot of the transfected cells is collected after 24 hours and the luciferase activity determined in the respective cell lysates. The number of colonies is always normed to the luciferase expression.

Figure 10:
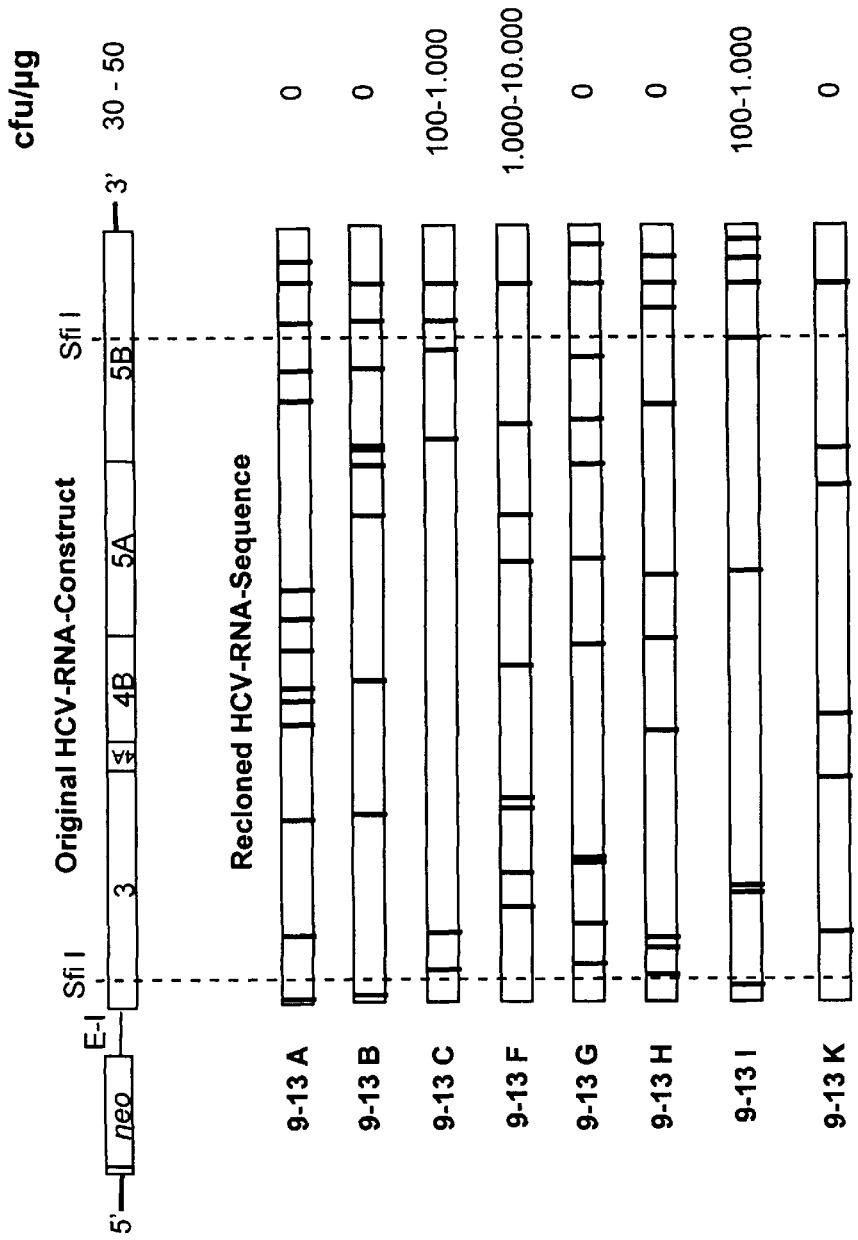

FIG. 10: Sequence analysis of the 9-13 clone. Total RNA of the 9-13 cell clone, resulting from transfection of HCV-RNA construct I377/NS3-3', was isolated using a known state of the art method and the HCV-RNA construct amplified from nucleotide position 59 to 9386 with the aid of 'long-distance RT-PCR' using primer S59 and A9413. The PCR fragments were cloned and 11 clones (9-13 A–K) completely sequenced. Clones D and I, E and G as well as H and J turned out to be identical, respectively. The positions of the amino acid differences in the. NS3-5B region between the recloned HCV-RNAs and the parental construct are marked with a thick vertical mark for each clone. Each clone was digested with restriction enzyme SfiI and the respective fragment inserted in the parental construct. These clones were each transfected in Huh-7 cells and the cells subjected to selection as described in FIG. 1. The number of cell clones obtained with each construct is noted next to the respective construct on the right.

FIG. 11A: Principle of determination of replication with the aid of a reporter gene. In the upper part of the figure, the HCV-DNA construct $I_{389}$/Luc/NS3-3' is shown. It consists of the HCV 5'to NTR (nucleotide positions 1–389), the luciferase gene (luc), the IRES of the encephalomyocarditis virus, the HCV NS3–5B and the 3'to NTR. The position of the active center of the NS5B RNA polymerase, into which a deactivating amino acid exchange was introduced, is indicated by 'GND'. The plasmids, which code for the HCV-RNA construct which is able to replicate or is defective, are digested with the restriction enzyme ScaI and added to an in vitro transcription reaction with T7 RNA polymerase. After removal of the template DNA, the respective HCV-RNA constructs were transfected in naive Huh-7 cells by means of electroporation and the latter collected at regular intervals.

FIG. 11B: Comparison of luciferase activity in cells transfected with the parental HCV-RNA construct $I_{389}$/Luc/NS3-3'/wt (wt) or the following variants: inactive RNA (318 DN), variants 9-13F or variant 5.1. The cells were collected 6 (not shown), 24, 48, 72, 96, 120, 144 and 168 hours after transfection and luciferase activities determined by luminometric measurement.

Figure 12:
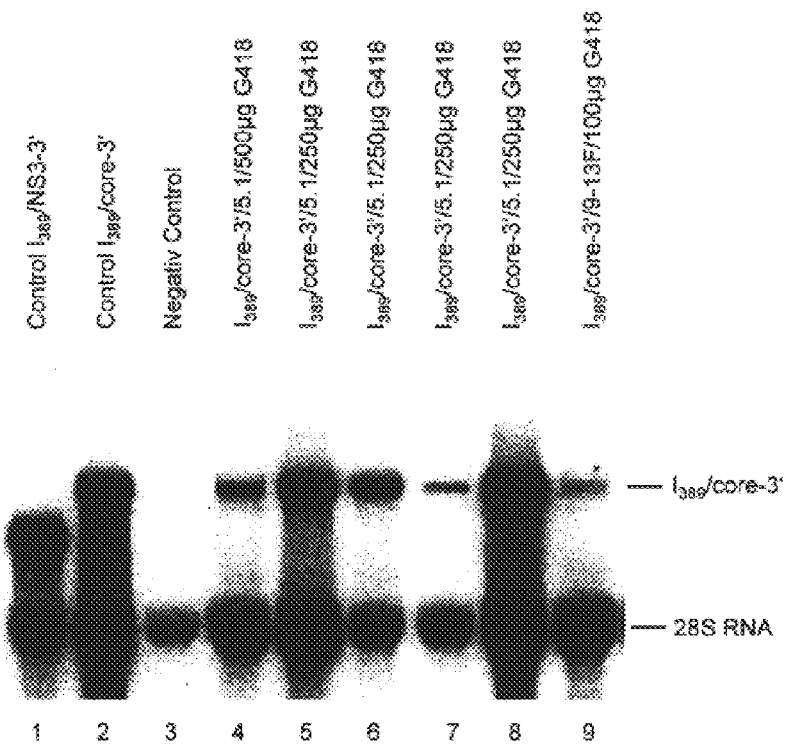

FIG. 12: Selectable HCV full-length genomes (constructs $I_{389}$/core 3'/5.1 and $I_{389}$/core 3'/9-13F).

(A) Diagram of the full-length construct. The region between both indicated recognition sites for the restriction enzyme SfiI corresponds to the sequences of the highly adapted RNA variants 5.1. or 9-13F.

(B) Number of colonies which were obtained after transfection of 0.1 µg in vitro transcribed RNA of the construct $I_{389}$/core-3'/5.1. described under A into HUH7-cells. The result of a representative experiment is given.

(C) Demonstration of autonomously replicating HCV full-length RNAs in G418 resistant cell clones which were obtained after transfection of the corresponding in vitro transcript. The illustration shows the autoradiogram of a Northern Blot, which was hybridised with a probe against the neo-resistance gene and the HCV 5'to NTR. The controls shown in lanes 1 and 2 each correspond to $10^8$ molecules of the indicated in vitro transcripts, mixed with total RNA from naive Huh-7 cells. The negative control contains only total RNA from naive Huh-7 cells (lane 3). Lanes 4–9 contain 3–10 µg total RNA from G418 resistant cell clones, which were obtained after transfection by in vitro transcribed $I_{389}$/core 3'/5.1 RNA or $I_{389}$/core 3'/9-13F RNA. The G418 concentration used for the selection is indicated in each case. Five of the cell clones shown contain the highly adapted RNA variant 5.1 (lanes 4–8), one contains the adapted RNA variant 9-13F (lane 9).

Figure 13:
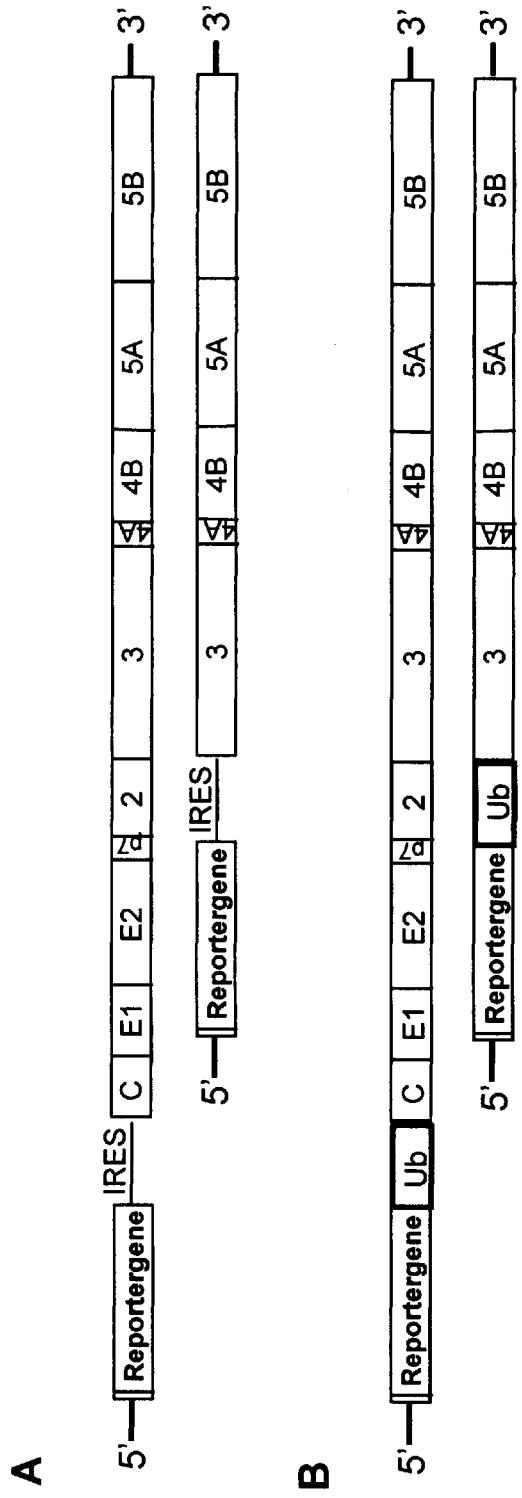

FIG. 13: HCV-RNA constructs with a reporter gene. (A) Bicistronic HCV-RNA constructs. The reporter gene is translated with the aid of a separate IRES. (B) Monocistronic HCV-RNA constructs. The reporter gene product is expressed as fusion protein with a HCV protein. Both portions are linked via a recognition sequence for a viral or cellular protease, which permits a proteolytic separation of the two fused protein portions. In the example shown the reporter gene product and respective HCV protein was fused through a recognition sequence for ubiquitin (Ub).

Figure 14:
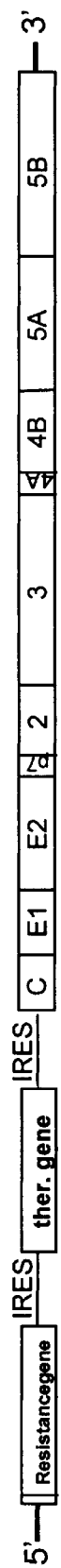

FIG. 14: Tricistronic full-length HCV-RNA construct, that in addition to the resistance gene possesses an inserted foreign gene (ther. gene).

Figure 15:
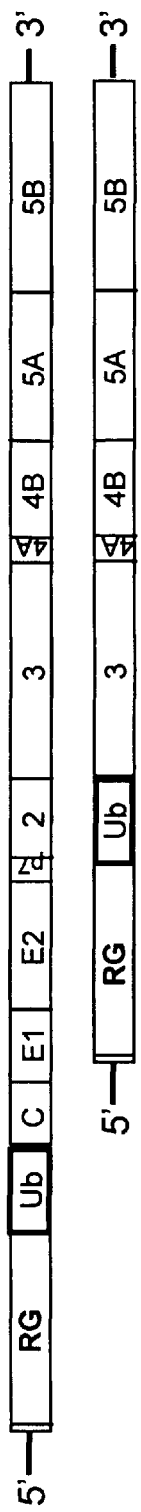

FIG. 15: Monocistronic HCV-RNA constructs, for which the resistance gene product is expressed as a fusion protein with HCV portion. The resistance gene (RG) is either active as a fusion protein or it is fused with the HCV portion via a proteolytically cleavable sequence in such a way that the resistance gene product is split from the HCV portion by a cellular or viral protease. In the example shown the resistance gene was fused with the respective HCV portion through the sequence coding for ubiquitin (Ub).

DETAILED DESCRIPTION OF THE CERTAIN PREFERRED EMBODIMENTS

The following examples illustrate various aspects of the present invention. They are not to be construed to limit the claims in any manner whatsoever.

EXAMPLE 1

Production of HCV-RNA Constructs
(A) Synthesis and Cloning of a Complete HCV Consensus Genome by Means of RT-PCR The HCV genome, which means the HCV-RNA, was isolated from the liver of a chronically infected patient as described in the following:

The total RNA was isolated from approx. 100 mg of liver according to the method described by Chomczynski and Sacci (1987, Anal. Biochem. 162,156). Using 1 μg of this isolated RNA a reverse transcription was carried out with the primers A6103 (GCTATCAGCCGGTTCATCCACTGC; SEQ ID NO: 36) or A9413 (CAGGATGGCCTATTGGCCTGGAG; SEQ ID NO: 38) and the expand reverse transcriptase system (Boehringer Mannheim, Germany) according to the manufacturer's recommendations. A polymerase chain reaction (PCR) was carried out with the products of this reverse transcription using the expand long template system (Boehringer Mannheim, Germany), in which the buffer containing 2% of dimethyl sulfoxide was used. After one hour at 42° C., ⅛ of the reaction mixture was used for a first PCR with primers A6103 and S59 (TGTCTTCACGCAGAAAGCGTCTAG; SEQ ID NO: 40) or A9413 and S4542 (GATGAGCT CGC-CGCGAAGCTGTCC; SEQ ID NO: 39). After 40 cycles, ⅒ of this reaction mixture was used for a second PCR with primers S59 and A4919 (AGCACAGCCCGCGTCATAGCACTCG; SEQ ID NO: 35) or S4542 and A9386 (TTAGCTCCCCGTTCATCGGTTGG; SEQ ID NO: 37). After 30 cycles the PCR products were purified by means of preparative agarose gel electrophoresis and the eluted fragments were ligated into the vector pCR2.1 (Invitrogen) or pBSK II (Stratagene). Four clones of each fragment were analyzed and sequenced, and a consensus sequence was established. For this purpose the DNA sequences were compared to each other. The positions, where the sequence of one fragment was different from the others, were considered as undesired mutations. In the case of ambiguities of the sequence, shorter overlapping PCR fragments of the respective region were amplified and several clones sequenced. By this means several potential mutations could be identified in each fragment and consequently an isolate specific consensus sequence could be established. This established consensus sequence or genome belongs to the worldwide spread genotype 1b. The non-translated region at the 3' end (=3'to NTR) was obtained by means of a conventional PCR, whereby an antisense primer, which covers the last 24 nucleotides of the 'X-tail' known from the state of the art was used (Tanaka et al., 1995, Biochem. Biophys. Res. Commun.215,744; und Rice, PCT/JS 96/14033). The authentic non-translated region on the 5' end (=5'to NTR) downstream of the T7 promoter was created by means of PCR, whereby an oligonucleotide, which corresponds to a shortened T7 promoter (TAA TAC GAC TCA CTA TAG; SEQ ID NO: 34) and the first 88 nucleotides of HCV, was used on one hand and one of the previously mentioned plasmids, which carries one of the 5' fragments of the genome, was used on the other hand. A complete HCV consensus genome was assembled from the subgenomic fragments with the smallest number of non-consensus replacements and inserted into a modified pBR322 vector. Deviations from the consensus sequence were eliminated by means of site-directed mutagenesis. In order to produce run-off transcripts with an authentic 3' end, the 3'to NTR of the isolates (with the end TGT) was modified to AGT (according to the sequence of the genotype 3=clone 'WS' according to Kolykhalov et al., 1996, J. Virol. 70, 3363) and an additional nucleotide replacement was carried out at position 9562, to preserve the A:T pairing in the hairpin structure at the 3' end of the 3'to NTR (Kolyhalov et al. ibid.). In order to eliminate an internal restriction site for the Scal enzyme, a silent nucleotide replacement was further carried out. After joining the full-length genome with the appropriate 5' and 3'to NTRs the complete HCV sequence was analyzed. No undesired nucleotide replacement was detected.

The HCV genome produced in this way should be hepatotropic according to the definition.
(B) Synthesis of Selectable HCV Subgenomic Constructs By means of the consensus genome described under (A), HCV subgenomic constructs were created, which include the antibiotic resistance gene neomycin phosphotransferase (NPT) and two sequences of internal ribosome entry sites (IRES) The biochemical procedures used for this are known and familiar to the expert (see: Sambrook, J., E. F. Fritsch, T. Maniatis, 1989, Molecularcloning: a laboratory manual, 2nd ed., Cold Spring Harbour Laboratory, Cold Spring Harbor, N.Y.; Ausubel et al. (eds.), 1994, Current Protocols in Molecular Biology, Vol. 1–3, John Wiley & Sons Inc., New York). The antibiotic resistance gene was inserted immediately after the 5'to NTR, obtaining a bicistronic RNA as a result (see FIG. 1A). However, the antibiotic resistance gene might as well be inserted at another site of the HCV subgenomic construct, for example within the nucleotide sequence encoding for the polyprotein, obtaining a monocistronic RNA as a result (see FIG. 5A), or in the 3'to NTR (see FIG. 5B). The IRES elements are one of the two HCV-IRES variants from nucleotides 1–377 or nucleotides 1–389 as well as the IRES of the encephalomyocarditis virus, which controls the translation of the HCV sequence downstream from the genes for NS2 or NS3 up to the authentic 3' end of the genome.

The two HCV-IRES variants mentioned were determined in the following way:

Based on deletion analyses of the 3' end of the HCV-IRES (Reynolds et al.1995, *EMBO J.* 14, 6010) various segments of the 5'to NTR were fused with the NPT gene and analyzed with regard to the maximum number of colonies formed by means of co-transfection with a plasmid containing the T7 RNA polymerase gene. The best results were achieved with the HCV sequences from 1–377 to 1–389. Due to the fact that the AUG start codon of the HCV polyprotein is located at position 342 and is consequently included in the IRES sequence, 12 or 16 amino acids of the HCV core protein ("core protein") were fused with the neomycin phosphotransferase (see FIG. 1A).

Accordingly, these modified HCV subgenomic constructs were given the designations $I_{377}$/NS2-3' (or $I_{377}$/NS3-3') and $I_{389}$/NS$^2$-3' (or $I_{389}$/NS3-3'). They are illustrated in a diagram in FIG. 1A.

Different cell lines and primary cell cultures of human hepatocytes were transfected with in vitro transcripts of these modified parental HCV subgenomic constructs $I_{377}$/NS2-3' (or $I_{377}$/NS3-3') and $I_{389}$/NS²-3' (or $I_{389}$/NS3-3').

As a parallel negative control for all transfection experiments, an appropriately modified, but defective subgenome was constructed for every modified parental HCV subgenomic construct, which differs from the parental construct due to the fact, that it has a deletion of 10 amino acids within the reading frame comprising the active site of the NS5B RNA polymerase (Behrens et al., 1996, *EMBO J.* 15, 12; and Lohmann et al., 1997, *J. Virol.* 71, 8416).

(C) Synthesis of Selectable HCV Genomic Constructs

A NS2-3' subgenomic construct, linked at its 5' end to a fragment of the luciferase gene and the complete EMCV-IRES, was restricted with NcoI and SpeI and purified using preparative agarose gel electrophoresis. The vector obtained in this way was ligated with a NcoI/NotI-HCV fragment corresponding to the nucleotide positions 342 to 1968 of the HCV genome and a NotI/SpeI fragment corresponding to the nucleotide positions 1968–9605 in a 3-factor-ligation. The resulting construct, where the complete HCV open reading frame and the 3'to NTR lie downstream from the luciferase gene fragment and the EMCV-IRES, was then restricted with PmeI and SpeI and ligated with the analogously restricted $I_{389}$/NS3-3'/wt subgenomic construct vector. This selectable HCV genomic construct is illustrated in FIG. 4.

(D) Production of in vitro Transcripts Corresponding to the HCV-RNA Constructs

The previously described purified plasmid DNAs were linearized with ScaI and used for an in vitro transcription reaction after phenol/chloroform extraction and isopropanol precipitation using the following components: 80 mM HEPES, pH 7.5, 12.5 mM $MgCl_2$, mM Spermidine, 40 mM Dithiothreitol, 2 mM of each NTP, 1 unit RNasin/µl, 50 µg/ml restricted DNA and approx. 2 units/µl T7 RNA polymerase. After 2 hrs. at 37° C. half of the amount of T7 polymerase was added and the reaction mixture was incubated for two further hours. In order to remove DNA the mixture was extracted with acid phenole (U. Kedzierski, J. C. Porte, 1991, Bio Techniques 10, 210), precipitated with isopropanol, the pellet was dissolved in water and incubated with DNase (2 units per µg DNA) for 60 min. at 37° C. After subsequent extraction with acid phenole, acid phenole/chloroform and chloroform as well as isopropanol precipitation the dissolved RNA was quantified using optical density measurement and its integrity was checked using formaldehyde-agarose gel electrophoresis.

EXAMPLE 2

Transfection Experiments with the Hepatoma Cell Line Huh 7

With all transfection experiments it was carefully ensured that any template DNA had been removed beforehand so as to avoid the possibility of this DNA integrating in transfected cells and conferring a neomycin resistance to them independent from HCV replication. The reaction mixture was therefore treated with 2 units of DNase per µg DNA for 60 min. at 37°C. after the in vitro transcription and extracted with acid phenole, acid phenole/chloroform and chloroform. Prior to being used for the transfection the precipitated RNA was analyzed using formaldehyde-agarose gel electrophoresis.

Three separate transfection experiments were carried out with the highly differentiated human hepatoma cell line Huh 7 (according to Nakabayashi et al. 1982, *Cancer Res.* 42, 3858). Each time 15 µg RNA were introduced into $8 \times 10^6$ Huh 7 cells by electroporation and the cells were seeded in culture dishes with a diameter of 10 cm. 24 hours after seeding, neomycin (=G418) was added in a final concentration of 1 mg/ml. The culture medium was changed twice a week. After 3–5 weeks small colonies were visible, which were isolated and grown under the same culture conditions.

The cell clones obtained during the first experiment were isolated and subpassaged. Most of the clones died during this procedure, and the final yield was only 9 clones from cells, which had been transfected with the parental HCV subgenomic constructs and 1 clone (clone 8-1) from cells, which had been transfected with a defective HCV genomic construct, namely a defective NS2-3' HCV-RNA. Apart from an extended doubling time and the occasional occurrence of irregularly shaped cells, no consistent morphological differences were found between these 9 cell clones and the single cell clone (clone 8-1) or the parental Huh 7 cells.

The main criteria for functioning HCV genomic constructs are the formation of viral RNA with the correct size and the absence of (integrated) plasmid DNA, which could transfer or mediate on a G418 resistance.

To determine the HCV-RNA in the Huh 7 cells, the total RNA was isolated and analyzed by means of the common Northern Blot method using a plus-strand specific ribo probe (RNA probe). For this purpose the total RNA was isolated from the respective cell clones according to the method described by Chomczynski and Sacchi 1987, *Anal. Biochem.* 162, 156 and 10 µg RNA, which is equivalent to the total RNA content of $0.5–1 \times 10^6$ cells, are separated using denatured formaldehyde-agarose gel electrophoresis (lanes 3 to 12 of FIG. 1B). At the same time $10^9$ in vitro transcripts (ivtr.), which correspond to the $I_{389}$/NS2-3'/wt or the $I_{389}$/NS3-3'/wt replicon RNAs, are separated as well as size markers with authentic sequence (lane 1 or lane 2). The separated RNA was transferred onto nylon-based membranes and hybridized with a radioactively labeled plus-strand specific RNA probe, which was complementary to the complete NPT gene and the HCV-IRES of nucleotide 377 to nucleotide 1. The positions of the HCV specific RNAs (arrows) and the 28S rRNA are specified to the right of lane 12, the size (amount of nucleotides) of the RNA marker is specified to left of lane 1. The RNA marker fragments contain HCV sequences and therefore hybridize with the ribo probe (=RNA probe). The results of this analysis are illustrated in FIG. 1B.

With the exception of clone 8-1 transfected with the defective HCV genomic construct, all cell clones produced homogenous HCV-RNAs of correct lengths (approx. 8640 nucleotides in the case of the NS2-3' and approx. 7970 nucleotides in the case of NS3-3' replicon). This result is an indication of the fact, that the functional replicons or the functional HCV genomic constructs transfer the G418 resistance. In order to exclude, that the G418 resistance is caused by a plasmid DNA, which is integrated in the genome of the Huh 7. host cell and transcribed under control of a cellular promoter, the DNA of each clone was analyzed by means of a NPT gene specific PCR. Consequently the DNA was isolated from the selected Huh 7 cell clones by means of digestion with proteinase K (40 µg/ml, 1 h, 37° C.) in 10 mM Tris, pH7.5, 1 mM EDTA, 0.5% SDS and subsequent extraction with phenol, phenol/chloroform and isopropanol precipitation. The DNA precipitate was dissolved in 10 mM Tris (pH 7,5) and 1 mM EDTA and incubated with Rnase A for 1 hour. Following a phenol/chloroform extraction and ethanol precipitation, 1 µg DNA, equivalent to $4–8 \times 10^4$ cells, was analyzed by means of PCR using NPT gene specific primers 5'-TCAAGACCGACCTGTCCGGTGCCC-3'; SEQ ID NO: 41; and 5'-CTTGAGCCTGGCGAACAGTTCGGC-3'; SEQ ID NO: 42), and a DNA fragment consisting of 379 nucleotides was generated. The specificity of the PCR product was established by means of the Southern Blot method, in which a DNA fragment labeled by digoxigenin was used, which corresponds to the NPT gene. As positive controls (for the detection of possibly contaminating nucleic acids) the PCR method was carried out with $10^7$ plasmid molecules or 1 μg DNA from a BHK cell line, which was stably transfected with a neomycin resistance gene, and as negative control, the PCR was carried out with the same reagents but without added DNA.

The results of this analysis are illustrated in FIG. 1C. The lanes 1 and 2 represent the positive controls, lane 13 represents the negative control. The numbers to the left of lane 1 indicate the sizes of the nucleotide marker molecules.

A NPT-DNA could not be detected in any cell clone, apart from clone 7-3 (FIG. 1C, lane 3), which was obtained from cells after transfection with a NS2-3' replicon/NS2-3' HCV genomic construct, and clone 8-1 (FIG. 1C, lane 12), which was obtained from cells after transfection with a defective HCV genomic construct. This result was another indication of the fact, that the G418 resistance of most clones was passed on by the replicating HCV-RNA. But even regardless of these results, it is unlikely, that integrated plasmid DNA produces HCV-RNAs of correct sizes, because the plasmids used for the in vitro transcription contain neither an eukaryotic promoter nor a polyadenylation signal. In the case of clone 7-3 the resistance is therefore very probably passed on by the HCV-RNA construct or the replicating HCV-RNA as well as by an integrated NPT DNA sequence, whereas the resistance of the cells of clone 8-1 is only caused by the integrated plasmid DNA.

Clone 9-13 (FIG. 1B, lane 11) was subject to further tests, to confirm that the G418 resistance was passed on by a self-replicating HCV-RNA. Clone 8-1, which carries the integrated copies of the NPT gene, was used throughout as negative control. A PCR was carried out, which allows the detection of <1000 NPT gene copies in ~40.000 cells, with the aim to rigorously exclude the presence of NPT-DNA in clone 9-13. The result of this PCR is illustrated in FIG. 2A. The PCR proceeded in detail as follows:

During the test, $10^6$–$10^2$ plasmid molecules ($I_{377}$/NS3-3'/wt) were used either directly (lanes 7–11) or after adding each 1 μg 9-13 DNA (lanes 2–6). The specificity of the amplified DNA fragment was determined by Southern Blot using a NPT specific probe. A PCR without DNA probe was carried out as negative control (lane 12).

Even with this sensitive method, no plasmid DNA could be detected in one μg DNA of the cell clone 9-13 (lane 1). To estimate the amount of HCV plus- and minus-strand RNAs in these cells, a dilution series of total RNA was analyzed with the Northern Blot method using a plus- or minus-strand specific radioactively labeled ribo probe (=RNA probe). For this purpose, 8, 4 or 2 μg of total RNA, which have been isolated from the cell clones 9-13 and 8-1, were analyzed in parallel to known amounts of in vitro transcripts with plus- or minus-strand polarity (control RNAs) in the Northern Blot method and were then subjected to a hybridization. The hybridization was carried out with a plus-strand specific ribo probe, which covered the complete NPT gene and the HCV-IRES ('plus-strand', top panel), or with a minus-strand specific RNA probe, which was complementary to the NS3 sequence ('minus-strand', bottom panel). The arrows mark the positions of replicon RNA. The results of this analysis are illustrated in FIG. 2B.

Approx. 108 copies/μg total RNA were detected in the case of the plus-strand, which is equivalent to 1000–5000 HCV-RNA molecules per cell, whereas the amount of minus-strand RNA was 5- to 10-times less. This result corresponds to the assumption, that the minus-strand RNA is the replicative intermediate form or intermediate copy, which is used as a template for the synthesis of the plus-strand molecules.

Due to the fact that the reaction is mainly catalyzed by the viral RNA-dependent RNA polymerase, the synthesis of the HCV-RNAs should be resistant to dactinomycin, an antibiotic, which selectively inhibits the RNA synthesis of DNA templates, but not the RNA synthesis from RNA templates. To confirm this assumption, cells were incubated with [$^3$H] uridine in the presence of dactinomycin, the radioactively labeled RNAs were extracted, separated by means of denaturing agarose gel electrophoresis and analyzed with the aid of a common Bio-Imager using a [$^3$H]-sensitive screen. For this purpose approx. $5 \times 10^5$ cells of the clones 9-13 and 8-1 were incubated at a time with 100 μCi [$^3$H] uridine for 16 hrs. in the absence (−) or presence (+) of 4 μg/ml of dactinomycin (Dact). Following this labeling reaction the total RNA was prepared and analyzed by means of formaldehyde-agarose gel electrophoresis. Only 1/10 of the total RNA is illustrated in the first two lanes. The radioactively labeled RNA was visualized using a BAS-2500 Bio-Imager (Fuji).

The results of this analysis are illustrated in FIG. 2C. In accordance with the inhibitor profile of the NS5B polymerase (Behrens et al., 1996, *EMBO J.* 15, 12 and Lohmann et al., 1997, *J. Virol.* 71, 8416), dactinomycin had no influence on the replication of the HCV RNA, whereas the synthesis of cellular RNA was inhibited. A RT-PCR was carried out for recloning the replicating sequences, to confirm the identity of the viral RNA. The sequence analysis of the recloned RNA showed that the RNA in clone 9-13 is HCV specific and corresponds to the transfected transcript of the HCV construct $I_{377}$/NS3-3'/wt.

For the analysis of the viral proteins, at first the respective cells were metabolically radioactively labeled with [35S] methionine/cysteine, then lysed and afterwards the HCV specific proteins were isolated from the cell lysates by means of immunoprecipitation. The results of these analyses are illustrated in FIG. 3A. The detailed procedure was as follows: Cells of the cell clones 9-13 (wt) and 8-1 (Δ) were metabolically radioactively labeled by treating them with a protein labeling mixture familiar to the expert and available on the market (for example, NEN Life Science). The HCV specific proteins were separated from the cell lysate by immunoprecipitation (IP) under non-denaturing conditions (for example according to Bartenschlager et al., 1995, *J. Virol.* 69, 7519) using three different antisera (3/4, 5A, 5B, according to the labeling on the top end of the lanes 1 to 12). The immune complexes were analyzed by means of tricine SDS-PAGE and made visible by means of autoradiography. To obtain authentic size markers, the homologous replicon construct $I_{377}$/NS3-3'/wt was subject to a transient expression by the vaccinia virus-T7 hybrid system in the Huh 7 cells. The resulting products were used as size markers (lanes 7–9) parallel to the cells of the clones 9-13 and 8-1. Identified HCV proteins are labeled on the left edge of lane 1, the molecular weights (in Kilodalton) are specified on the right edge of lane 9. It should be noted that the NS3/4 specific antiserum ('3/4') used preferably reacts with NS4A and NS4B causing an underrepresentation of NS3.

All viral antigens could unambiguously be detected, and their apparent molecular weights did not show any difference to those being detected after transient expression of the same bicistronic HCV-RNA construct in the original Huh 7 cells. An immunofluorescence detection reaction was carried out using NS3 and NS5A specific antisera, to determine the subcellular distribution of the viral antigens (for example according to Bartenschlager et al., 1995, *J. Virol.* 69, 7519). For this purpose cells of the clones 9-13 (wt) and 8-1 (Δ) were fixed with methanol/acetone 24 hrs. after incubating on coverslips and incubated with polyclonal NS3 or NSSA specific antisera. The bound antibodies were made visible with a commercially available FITC conjugated anti-rabbit antiserum. The cells were counterstained with the 'Evans Blue' stain to suppress unspecific fluorescence signals.

The results of this detection test are illustrated in FIG. 3B. A strong fluorescence in the cytoplasm could be detected with both antisera. The NS5A specific antiserum also caused a slight nuclear fluorescence, which indicates that at least small amounts of this antigen also reach the nucleus. But the generally dominating presence of the viral antigens in the cytoplasm are a strong indication that HCV-RNA replication occurs in the cytoplasm, as is the case with most RNA viruses.

These results prove clearly that the establishment of a cell culture system for the HCV could be accomplished with the test arrangement described, the efficiency of which surpasses everything known up until now by far and for the first time allows the detection of viral nucleic acids and proteins with conventional and approved biochemical methods. This efficiency actually allows detailed examination of HCV pathogenesis, genetic analyses of different HCV functions and a precise study of the virus/host cell interaction, through which new starting points for the development of a antiviral therapy can be defined.

EXAMPLE 3

Transfection of Huh 7 Cells with HCV Total Constructs

Huh7 cells are transfected and selected as described in example 2, whereby in this case selectable constructs are used, which contain the complete virus genome. Corresponding to Example 2, the resulting cell clones are tested for the absence of HCV-DNA by means of PCR and the productive replication of HCV-RNA is then established by means of Northern Blot, [$^3$H]uridine labeling in the presence of dactinomycin, detection of the viral proteins or antigens preferably with the aid of the Western Blot, the immunoprecipitation or immunofluorescence. In contrast to the arrangements described in Example 2, the construct described here makes it possible to obtain more complete and very likely infectious viruses, which has not been the case in the subgenomic constructs described in Example 2. These viruses existing in the cell and the cell culture supernatant are concentrated for example by means of ultracentrifugation, immunoprecipitation or precipitation with polyethyleneglycol, and all exogenous nucleic acids, which means those that are not incorporated into the virus particle, are digested by incubation with nucleases (RNase, DNase, micrococal nuclease). In this way all contaminating nucleic acids, which are not included in the protecting virus particle, can be removed. After inactivation of the nucleases, the protected viral RNA is isolated for example by means of incubation with proteinase K in a buffer containing SDS, by extracting with phenol and phenol/chloroform and detected by means of Northern Blot or RT-PCR, using HCV specific primers. Also in this test arrangement, the combination of the HCV consensus genome described with a selection marker was crucial for the efficient production of viral RNA, viral protein and therefore HCV particles.

EXAMPLE 4

Production and Application of a HCV-RNA Construct, Whereby the Resistance Gene is Linked to the HCV Subgenomic Sequence via a Ribozyme or a Recognition Site for a Ribozyme A HCV-RNA construct is produced according to Example 1 or Example 3, where an antibiotic resistance gene is linked to the HCV-RNA sequence through a ribozyme or a recognition sequence for a ribozyme. These constructs are illustrated in a diagram in FIG. 7. Huh 7 cells are transfected with this HCV-RNA construct as described in Example 2. A selection with the appropriate antibiotic follows the transfection into the cells. The inserted ribozyme is activated in the cell clones obtained in the procedure or, in the case of a construct, which carries a recognition sequence for a ribozyme, the ribozyme is transfected into the cell (for example by means of transfection of a ribozyme construct or infection with a viral expression vector, into which the respective ribozyme has been inserted). In both cases the resistance gene is separated from the HCV-RNA sequence by the ribozyme-dependent cleavage. The result in the case of the HCV genome is an authentic HCV genome without a resistance gene, which can form authentic infectious virus particles. A HCV replicon without resistance gene is created in the case of the HCV subgenomic constructs.

EXAMPLE 5

Co-transfection of a HCV-RNA Construct with a Separate Luciferase Transfection Construct A HCV-RNA construct is produced according to Example 1 (A) or Example 3 or Example 4. At the same time a transfection construct is produced, which comprises the luciferase gene, whereby this luciferase gene is linked to a first nucleotide sequence, which encodes a HCV protease (for example NS3 protease) cleavage site, to a second nucleotide sequence, which encodes for another protein or a part of another protein. HCV-RNA construct and transfection construct are transfected into any host cells, preferably hepatoma cells, most preferably Huh 7 cells. This can be realized as described in Example 2. The product of the modified luciferase gene is a luciferase fusion protein, where the luciferase is inactivated due to the fusion with the foreign part. The fusion protein, which contains a recognition sequence for a HCV protease, is cleaved in transfected cells with high HCV replication, and consequently the active form of the luciferase, which can be identified through luminometric measurement, is released. If the replication of the HCV-RNA construct is inhibited the fusion protein will not be cleaved and no active luciferase will be released. The quantitative determination of the luciferase is therefore a measure for the replication of the HCV construct. Instead of the luciferase gene, another reporter gene can just as easily be used, which is modified in the same way, so that its expression depends on the viral replication, although this reporter gene is not part of the HCV construct. A cellular protein, which is deactivated or activated by the HCV proteins or nucleic acid, can also be used as a so called surrogate marker. The expression or activity of this surrogate marker is in this case a measure for the replication of the viral DNA.

EXAMPLE 6

Production of HCV Subgenomic Constructs with Integrated Foreign Genes to be Used as Liver Cell Specific Vector in Gene Therapy These recombinant and selectable HCV subgenomic constructs are transfected in transcomplementing helper cell lines, which means in cell lines, which express the missing functions (for example the structural proteins) in an inducible or constitutive way. Cell clones containing a functional HCV subgenomic construct can be established through appropriate selection. The viral structural proteins expressed from the host cell allow the formation of virus particles, into which the RNA of the HCV subgenomic constructs will be transfected. The results are therefore virus-like particles, which contain a HCV subgenomic construct according to the invention including the inserted foreign gene and which can transmit this to other cells by means of infection. An example for this construct is illustrated in FIG. 8.

It is also possible to use the HCV subgenomic construct with integrated foreign gene directly as an expression vector. This involves the same method as mentioned previously except that cell lines, which do not express transcomplementing factors, a re transfected. In this case the HCV construct is only used as an expression vector.

EXAMPLE 7

Production of Cell Culture Adapted HCV-RNA Constructs (A) Method of Isolation

The following method was used to determine adaptive mutations and to produce cell culture adapted HCV-RNA constructs: cells were transfected with a HCV-RNA construct as described in Examples 1 and 2 and G418-resistant cell clone produced. For the determination of ability to replicate (understood in this context to be the number of G418 resistant cell clones obtained per microgram of transfected HCV-RNA or HCV-RNA construct), the total RNA from one of the cell clones, [the 9-13 clone (FIG. 1B, lane 11)], was isolated and the quantity of HCV-RNA contained within it was determined by Northern Blot as described in FIG. 2B. Ten micrograms of the total RNA, containing approx. $10^9$ molecules of HCV-RNA, was then transfected into naive Huh-7 cells using electroporation (FIG. 9). In parallel, $10^9$ in vitro transcripts of the analoguous neo-HCV-RNA, which had been adjusted with isolated total RNA from naive Huh-7 cells to a total RNA quantity of 10 µg, were transfected in naive Huh-7 cells. After selection with G418, the number of cell colonies, expressed as 'colony forming units (cfu) per microgram RNA', was determined in both these cultures. At a concentration of 500 µg/ml G418 in the selection medium, the number of colonies obtained with the HCV-RNA contained in isolated total RNA from clone 9-13, was approx. 100,000 cfu per microgram HCV-RNA. In contrast, only 30–50 colonies were obtained with the same quantity of in vitro transcribed HCV-RNA. This result confirms that the specific infectivity of the HCV-RNA isolated from the cell clones is approx. 1,000–10,000 times higher than the infectivity of the analoguous in vitro transcripts. The experimental approach is shown in FIG. 9.

With the aid of 'long-distance RT-PCR', the HCV-RNA was amplified from the total RNA of the 9-13 cells, the PCR amplificate was cloned and numerous clones were sequenced. A comparison of the sequences of these recloned RNAs with the sequence of the RNA originally transfected into the naive Huh-7 cells, showed that the recloned RNAs possessed numerous amino acid exchanges distributed over the whole HCV sequence (FIG. 10). SfiI fragments of these recloned mutants were used to replace the analoguous SfiI fragment of the original replicon construct, and RNAs of the respective mutants were transfected in naive Huh-7 cells. After selection with G418 the number of colonies created was determined for each HCV-RNA mutant. While only 30–50 colonies per microgram RNA were obtained with the parental RNA the number of colonies was noticeably higher for two of the recloned variants (FIG. 10). In the case of the HCV-RNA constructs 9-13I and 9-13C the specific infectivity was increased to 100–1,000 cfu per microgram RNA and for 9-13F replicon it was 1,000–10,000 cfu per microgram RNA. These results show that the amino acid exchanges in the analyzed NS3-5B regions of the mutants 9-13I, 9-13C and particularly of 9-13F, led to a considerable increase in ability to replicate. In contrast all the other HCV-RNA constructs. (9-13 A, B, G, H und K) were no longer able to replicate, they thus contained lethal mutations.

In order to answer the question which of the amino acid exchanges in the 9-13F construct led to an increase in replication, the exchanges were introduced separately or in combination into the parental HCV-RNA construct, and the corresponding RNAs transfected in naive Huh-7 cells. The result of the transfection with these RNAs is summarized in Table 1. From this it is evident that in the present example the high ability to replicate is determined by several mutations. The amino acid exchanges in the HCV-RNA regions NS5A and NS4B make the greatest contribution. The single exchanges in the NS3-Region also make a contribution and perhaps they are synergistic.

These results confirm that it was through the G418 selection of the cells transfected with the neo-HCV-RNA construct that there was enrichment of those HCV-RNAs having noticeably higher ability to replicate. HCV-RNA constructs with greatly differing replication efficiencies can be selected using the experimental approach described here. The higher the concentration of the antibiotic in the selection medium, in/on which the HCV-RNA construct containing cells are cultivated for selection, the higher must be the extent of adaptive mutations and hence replication efficiency of the relevant HCV-RNA constructs, to allow the cells to grow under these conditions. If the selections are carried out using lower antibiotic concentrations, cells can survive and multiply, but the HCV-RNA construct shows a comparatively lower replication efficiency and fewer adaptive mutations.

As has been shown, the 9-13F HCV-RNA construct described so far, which contains several adaptive mutations, had a higher replication efficiency than the parental HCV-RNA. In order to obtain HCV-RNAs with even higher replication in cell culture, the HCV-RNA contained in the total RNA of a selected cell clone was passaged several times in naive Huh-7 cells. The selected 5-15 cell clone, was obtained by transfection with the HCV-RNA construct $I_{389}$/NS3-3' (FIG. 1).

It largely corresponds to the cell clone 9-13, produced by transfection with a HCV-RNA construct, having a HCV-IRES shorter by 22 nucleotides ($I_{377}$/NS3-3'; FIG. 1). Ten micrograms of total RNA, isolated from cell clone 5-15, were transfected into naive Huh-7 cells using electroporation and the cells subjected to a selection with 1 mg/ml G418. The total RNA from one of the cell clones thus produced was again isolated, transfected into naive Huh-7 cells and selected in the same way. This process was repeated a total of four times. After the fourth passage the total RNA was isolated from a cell clone and the neo-HCV-RNA amplified with the aid of the 'long-distance RT-PCR'. The amplified DNA fragment was digested with the restriction enzyme SfiI and inserted into the SfiI-restricted parental construct $I_{389}$/NS3-3'. Over 100 DNA clones were obtained altogether and then analyzed by means of restriction digestion. In vitro transcribed RNA of about 80 of these clones was each transfected into naive Huh-7 cells and subjected to a selection with 500 mg/ml G418. Of the 80 neo-HCV-RNA variants examined, the great majority proved to be replication defective. However, the specific infectivity, expressed as 'colony forming units' per microgram RNA, was noticeably increased in the case of two mutants, 5.1 and 19 (Table 2). Through several passages of the RNA in cell culture it is clear that HCV-RNAs are produced whose replication efficiency due to mutations ("adaptive mutations") is several orders of magnitude higher than the original RNA cloned from patients.

(B) Modified Method

Adaptive mutations produced and identified according to (A) can be transferred into a HCV-RNA construct with low ability to replicate. This leads to a huge increase in the replication of this construct. The increase is so great it can be demonstrated that HCV-RNAs transfected into cell culture can replicate even in the absence of selection pressure FIG. 12 shows a comparison of the replication efficiency of HCV-RNAs, which corresponded either to the starting sequence or to the adaptive sequences 9-13F or 5.1. For the purposes of simple measurement, the neo-gene was removed and replaced by the gene for luciferase. The negative control used was again a HCV-RNA construct that was replication defective due to a deactivating mutation in the NS5B RNA polymerase. Already 24 hours after transfection a noticeable difference is evident in luciferase activity between the defective RNA and the 9-13F or 5.1 constructs, while hardly any difference could be seen between the defective RNA (318 DN) and the parental RNA construct (wt) that possessed no adaptive mutations. During the whole period of observation, the highest luciferase activity, and thus highest replication, was obtained with the 5.1-RNA. These results not only confirm the high replication efficiency of this RNA, but also show that it is possible to create a cell culture system with adapted HCV-RNA constructs for which the presence of a selectable gene is no longer necessary. A summary of the nucleotide and amino acid differences between the starting construct and the mutants 9-13F, 5.1 and 19 is presented in Table 3.

EXAMPLE 8

Production of Cell Culture Adapted HCV-RNA Full-length Genome

In the examples 1 to 7 a subgenomic HCV-RNA was used which lacked the whole structural protein region from core up to p7 or even NS2. It will be shown in this example that it is possible to make a HCV full-length genome replicate in cell culture with the aid of an adapted NS3-5B sequence. For this purpose the SfiI fragment of the highly adapted HCV-RNA 5.1 produced according to Example 7 is first transferred into a selectable HCV full-length genome (FIG. 12). This HCV genome was transfected into naive Huh-7 cells and subjected to selection with various G418 concentrations. Depending on the strength of selection (the G418 concentration), a varying large number of cell clones was obtained (FIG. 12B). By contrast no colonies were obtained with the parental HCV full-length genome containing no adaptive mutations, as was the case for the negative control, which was replication defective due to a deactivating mutation in the NS5B RNA polymerase. To confirm that the thus resulting cell clones really contained an autonomously replicating HCV full-length construct, total RNA from several cell clones was isolated and analyzed by means of the Northern Blot method. The full-length HCV-RNA was clearly detectable in all cell clones (FIG. 12). It is thus clearly confirmed, that with the aid of cell culture adapted HCV sequences it is possible to produce a HCV full-length genome, which replicates highly efficiently and autonomously in a cell line, i.e. adapted HCV full-length genomes can also be produced with the system of the invention. Furthermore, as this clone possesses the complete HCV sequence, i.e. it also possesses the structural proteins necessary for virus particle formation, it is possible to produce large quantities of infectious virus particles in cell cultures with this system. As a confirmation of these viruses, cell-free cell supernatants carrying a replicating HCV full-length genome, are added to naive Huh-7 cells and the thus infected cells subjected to selection with G418. Each cell clone growing under these conditions originates from an infected cell. The viruses in the cell culture supernatant of cells possessing a replicating HCV full-length genome can be enriched and purified using various known state of the art methods such as ultracentrifugation or microdialysis. They can then be used for the infection of naive cells. Using this method it is clearly demonstrated that cell culture adapted full-length genomes can be produced with the HCV cell culture system of the invention. These genomes replicate with high efficiency in cells and produce infectious viruses. The latter can be detected by infection of an experimental animal, preferably a chimpanzee.

EXAMPLE 9

Production of HCV Full-length Constructs and HCV Subgenomic Constructs with Reporter Genes A HCV-RNA construct is produced in which a reporter gene is inserted in place of the antibiotic resistance gene (FIG. 13). Replication can thereby be determined through the quantity or activity of the reporter gene or reporter gene product. The reporter gene is preferably a gene from the group of the luciferase genes, the CAT gene (chloramphenicol acetyl transferase gene), the lacZ gene (beta galactosidase gene), the GFP gene (green fluorescence protein gene), the GUS gene (glucuronidase gene) or the SEAP gene (secreted alkaline phosphatase gene). This reporter gene and its products, namely the relevant reporter proteins, can be detected for example using fluorescence, chemiluminescence, colorimetrically or by means of immunological methods (for example, enzyme-linked immunosorbent assay, ELISA). The reporter gene can be expressed either from a separate IRES or in the form of a fusion protein, which is active either as such or fused with a HCV protein via a poteolytically cleavable amino acid sequence in such a way that the reporter is separated from the HCV protein by cleavage of a cellular or viral (HCV) protease.

EXAMPLE 10

Production of HCV Full-length Constructs with Integrated Foreign Genes Used as Liver Cell Specific Vectors for Gene Therapy or as Expression Vectors The construct (FIG. 14) is transfected in cells and leads to the formation of HCV virus particles that can be used for the infection of further cells. Since the virus particles have encapsidated RNA with a foreign gene, it can be used in the infected cells for the production of the protein coded by this foreign gene. Cells transfected with the construct also express the foreign gene.

EXAMPLE 11

Production of Monocistronic HCV-RNA Constructs in Which the Resistance Gene Product is Expressed as a Fusion Protein With the HCV Portion It is an advantage for some tests if the HCV-RNA construct does not possess a heterologous IRES element. Tests of this type are, for example, the determination of interferon resistance. If a cell possessing a HCV-RNA construct is incubated with interferon alpha or beta, a reduction in replication of the HCV-RNA results. In order to explain the mechanism of this effect it is necessary for the HCV-RNA construct not to possess any heterologous IRES, as otherwise it is not possible to determine whether the interferon mediated inhibition is via inhibition of the HCV replication or inhibition of the heterologous IRES. For this reason constructs are produced for which the resistance gene is fused with a HCV protein (FIG. 15). Either the fusion protein is active as such or the resistance gene product is linked to a HCV protein via a proteolytically cleavable amino acid sequence in such a way that it is separated from the HCV protein by a cellular or viral (HCV) protease.

TABLE 1

Specific infectivities (cfu/μg RNA) of HCV RNA constructs with adaptive mutations found with the 9-13F mutant introduced into the parental construct $I_{389}$/NS3-3'/wt

| amino acid exchange[1] | HCV protein | cfu/μg RNA[2] |
| --- | --- | --- |
| none |  | 30–60 |
| 1283 arg -> gly | NS3 | 200–250 |
| 1383 glu -> ala | NS3 | 30–60 |
| 1577 lys -> arg | NS3 | 30–60 |
| 1609 lys -> glu | NS3 | 160–300 |
| (1283 arg -> gly + 1383 glu -> ala + 1577 lys -> arg + 1609 lys -> glu) | NS3 | 360–420 |
| 1936 pro -> ser | NS4B | 1000–5000 |
| 2163 glu -> gly | NS5A | 1000–5000 |
| 2330 lys -> glu | NS5A | 30–60 |
| 2442 ile -> val | NS5A | 30–60 |
| all together |  | 5000 |

[1]amino acid change in the polyprotein of the HCV isolate con 1 (EMBL-gene bank No. AJ238799); amino acids are given in single letter code.
[2]Colony forming units (number of cell clones) obtained with a selection of 500 μg/ml G418.

TABLE 2

Specific infectivities (cfu/μg RNA) of the parental HCV RNA construct $I_{389}$/NS3-3'/wt and the variants 9-13I, 9-13F, 5.1 and 19.

| Transfected RNA variant | cfu/μg RNA[1] |
| --- | --- |
| wild type | 30–50 |
| 9-13 I | 100–1.000 |
| 9-13 F | 1.000–10.000 |
| 5.1 | 50.000–100.000 |
| 19 | 50.000–100.00 |

[1]Colony forming units (number of cell clones) obtained with a selection of 500 μg/ml G418.

TABLE 3

Nucleotide and amino acid sequence differences between the parental HCV RNA construct $I_{389}$/NS3-3'/wt and the mutants 9-13I, 9-13F, 5.1 und 19

| Clone | nt-position | nt-exchange | aa-exchange |
| --- | --- | --- | --- |
| 9-13 I | 3685 | C > T | P > L |
|  | 4933 | C > T | T > M |
|  | 5249 | T > C | — |
|  | 8486 | C > T | — |
|  | 8821 | G > A | W > stop |
|  | 8991 | C > G | R > G |
|  | 9203 | A > G | — |

TABLE 3-continued

Nucleotide and amino acid sequence differences between the parental HCV RNA construct $I_{389}$/NS3-3'/wt and the mutants 9-13I, 9-13F, 5.1 und 19

| Clone | nt-position | nt-exchange | aa-exchange |
| --- | --- | --- | --- |
|  | 9313 | T > C | F > S |
|  | 9346 | T > C | V > A |
| 9-13 F | 3866 | C > T | — |
|  | 4188 | A > G | R > G |
|  | 4489 | A > C | E > A |
|  | 4562 | G > A | — |
|  | 4983 | T > C | — |
|  | 5071 | A > G | K > R |
|  | 5166 | A > G | K > E |
|  | 6147 | C > T | P > S |
|  | 6829 | A > G | E > G |
|  | 7329 | A > G | K > E |
|  | 7664 | A > G | I > V |
|  | 8486 | C > T | — |
|  | 8991 | C > G | R > G |
| NK5.1 | 4180 | C > T | T > I |
|  | 4679 | C > T | — |
|  | 4682 | T > C | — |
|  | 5610 | C > A | L > I |
|  | 6437 | A > G | — |
|  | 6666 | A > G | N > D |
|  | 6842 | C > T | — |
|  | 6926 | C > T | — |
|  | 6930 | T > C | S > P |
|  | 7320 | C > T | P > S |
|  | 7389 | A > G | K > E |
| NK19 | 3946 | A > G | E > G |
|  | 4078 | C > G | A > G |
|  | 4180 | C > T | T > I |
|  | 4562 | T > C | — |
|  | 5610 | C > A | L > I |
|  | 5958 | A > T | M > L |
|  | 6170 | T > A | — |
|  | 6596 | G > A | — |
|  | 6598 | C > G | A > G |
|  | 6833 | C > T | — |
|  | 6842 | C > T | — |
|  | 6930 | T > C | S > P |
|  | 7141 | A > G | E > G |
|  | 7320 | C > T | P > S |
|  | 7389 | A > G | K > E |
|  | 7735 | G > A | S > N |

Given are the differences between the nucleotide and amino acid sequences of the parental HCV RNA sequence con 1 (EMBL-gene bank No. AJ238799) and those of the cell culture adapted HCV RNAs. Numbers refer to the nucleotide and amino acid positions of the con 1 isolate. nt, nucleotide; aa, amino acid.

SEQUENCE LISTING (51 sequences)

SEQ ID NO: 1 - DNA, 11076 bp, Hepatitis C virus
  5'UTR (1)..(341): construct I389/Core-3'/wt
  CDS (342)..(1193): hepatitis C virus core - neomycin phosphotransferase fusion protein
  RBS (1202)..(1812): internal ribosome entry site from encephalomyocarditis virus
  CDS (1813)..(10845): hepatitis C virus polyprotein from core to nonstructural protein NS5B; parental sequence without cell culture-adaptive mutations
  3'UTR (10846)..(11076)
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatgggcacgaatcctaaacctcaaagaaaaaccaaacgtaacaccaaccgccgcccacaggacgtcaagttcccgggcggtggtcagatcgtcggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccctggcccctctatggcaatgagggcttggggtgggcaggatggctcctgtcaccccgtggctctcggcctagttggggccccacggacccccggcgtaggtcgcgcaatttgggtaaggtcatcgataccctcacgtgcggcttcgccgatctcatggggtacattccgctcgtcggcgcccccctagggggcgctgccagggccctggcgcatggcgtccgggttctggaggacggcgtgaactatgcaacagggaatctgcccggttgctccttttctatcttccttttggctttgctgtcctgtttgaccatcccagcttccgcttatgaagtgcgcaacgtatccggagtgtaccatgtcacgaacgactgctccaacgcaagcattgtgtatgaggcagcggacatgatcatgcatacccccgggtgcgtgccctgcgttcgggagaacaactcctcccgctgctgggtagcgctcactcccacgctcgcggccaggaacgctagcgtccccactacgacgatacgacgccatgtcgatttgctcgttggggcggctgctctctgctccgctatgtacgtgggagatctctgcggatctgttttcctcgtcgcccagctgttcaccttctcgcctcgccggcacgagacagtacaggactgcaattgctcaatatatcccggccacgtgacaggtcaccgtatggcttgggatatgatgatgaactggtcacctacagcagccctagtggtatcgcagttactccggatcccacaagctgtcgtggatatggtggcgggggcccattggggagtcctagcgggccttgcctactattccatggtggggaactgggctaaggttctgattgtgatgctactctttgccggcgttgacgggggaacctatgtgacaggggggacgatggccaaaaacaccctcgggattacgtccctcttttcacccgggtcatcccagaaaatccagcttgtaaacaccaacggcagctggcacatcaacaggactgccctgaactgcaatgactccctcaacactgggttccttgctgcgctgttctacgtgcacaagttcaactcatctggatgcccagagcgcatggccagctgcagccccatcgacgcgttcgctcaggggtgggggcccatcacttacaatgagtcacacagctcggaccagaggccttattgttggcactacgcaccccggccgtgcggtatcgtacccgcggcgcaggtgtgtggtccagtgtactgcttcaccccaagccctgtcgtggtggggacgaccgaccggttcggcgtccctacgtacagttggggggagaatgagacggacgtgctgcttcttaacaacacgcggccgccgcaaggcaactggtttggctgtacatggatgaatagcactgggttcaccaagacgtgcgggggccccccgtgtaacatcggggggatcggcaataaaaccttgacctgccccacggactgcttccggaagcaccccgaggccacttacaccaagtgtggttcggggccttggttgacacccagatgcttggtccactacccatacaggctttggcactacccctgcactgtcaactttaccatcttcaaggttaggatgtacgtggggggagtggagcacaggctcgaagccgcatgcaattggactcgaggagagcgttgtaacctggaggacagggacagatcagagcttagcccgctgctgctgtctacaacggagtggcaggtattgccctgttccttcaccaccctaccggctctgtccactggtttgatccatctccatcagaacgtcgtggacgtacaatacctgtacggtatagggtcggcggttgtctcctttgcaatcaaatgggagtatgtcctgttgctcttccttcttctggcggacgcgcgcgtctgtgcctgcttgtggatgatgctgctgatagctcaagctgaggccgccctagagaacctggtggtcctcaacgcggcatccgtggccggggcgcatggcattctctccttcctcgtgttcttctgtgctgcctggtacatcaagggcaggctggtccctggggcggcatatgccctctacggcgtatggccgctactcctgctcctgctggcgttaccaccacgagcatacgccatggaccgggagatggcagcatcgtgcggaggcgcggttttcgtaggtctgatactcttgaccttgtcaccgcactataagctgttcctcgctaggctcatatggtggttacaatattttatcaccagggccgaggcacacttgcaagtgtggatcccccccctcaacgttcgggggggccgcgatgccgtcatcctcctcacgtgcgcgatccacccagagctaatctttaccatcaccaaaatcttgctcgccatactcggtccactcatggtgctccaggctggtataaccaaagtgccgtacttcgtgcgcgcacacgggctcattcgtgcatgcatgctggtgcggaaggttgctgggggtcattatgtccaaatggctctcatgaagttggccgcactgacaggtacgtacgtttatgaccatctcaccccactgcgggactgggcccacgcgggcctacgagaccttgcggtggcagttgagcccgtcgtcttctctgatatggagaccaaggttatcacctggggggcagacaccgcggcgtgtggggacatcatcttgggcctgcccgtctccgcccgcagggggagggagatacatctgggaccggcagacagccttgaagggcaggggtggcgactcctcgcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaaccggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggcgatttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggacgtagcagtgctcacttccatgctcaccgacccctcccacattacggcggagacggctaagcgtaggctggccaggggatctcccccctccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccacctccacggaggaagaggacggttgtcctgtcagaatctaccgtgtcttctgccttggcggagctcgccacaaagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 2 - protein, 283 aa, Hepatitis C virus
MSTNPKPQRKTKRNTNGRAMIEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKARMPDGEDLVVTHGDACLPNIMVENGRFSGFIDCGRLGVADRYQDIALATRDIAEELGGEWADRFLVLYGIAAPDSQRIAFYRLLDEFF

SEQ ID NO: 3 - protein, 3010 aa, Hepatitis C virus
MGTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVVDMVAGAHWGVLAGLAYYSMVGNWAKVLIVMLLFAGVDGGTYVTGGTMAKNTLGITSLFSPGSSQKIQLVNTNGSWHINRTALNCNDSLNTGFLAALFYVHKFNSSGCPERMASCSPIDAFAQGWGPITYNESHSSDQRPYCWHYAPRPCGIVPAAQVCGPVYCFTPSPVVVGTTDRFGVPTYSWGENETDVLLLNNTRPPQGNWFGCTWMNSTGFTKTCGGPPCNIGGIGNKTLTCPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLILLTLSPHYKLFLARLIWWLQYFITRAEAHLQVWIPPLNVRGGRDAVILLTCAIHPELIFTITKILLAILGPLMVLQAGITKVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGREIHLGPADSLEGQGWRLLAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGIDPNIRTGVRTITTGAPITYSTYGKFLADGGCSGGAYDIIICDECHSTDSTTILGIGTVLDQAETAGARLVVLATATPPGSVTVPHPNIEEVALSSTGEIPFYGKAIPIETIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTLEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFLVGLNQYLVGSQLPCEPEPDVAVLTSMLTDPSHITAETAKRRLARGSPPSLASSSASQLSAPSLKATCTTRHDSPDADLIEANLLWRQEMGGNITRVESENKVVILDSFEPLQAEEDEREVSVPAEILRRSRKFPRAMPIWARPDYNPPLLESWKDPDYVPPVVHGCPLPPAKAPPIPPPRRKRTVVLSESTVSSALAELATKTFGSSESSAVDSGTATASPDQPSDDGDAGSDVESYSSMPPLEGEPGDPDLSDGSWSTVSEEASEDVVCCSMSYTWTGALITPCAAEETKLPINALSNSLLRHHNLVYATTSRSASLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 4 - DNA, 8637 bp, Hepatitis C virus
  5'UTR (1)..(341): construct I377/NS2-3'/wt
  CDS (342)..(1181): HCV core-neomycin phosphotransferase fusion protein
  RBS (1190)..(1800): internal ribosome entry site from encephalomyocarditis virus
  CDS (1801)..(8406): hepatitis C virus NS2 - 5B
  3'UTR (8407)..(8637)
  ref <301>: AUTHORS: Lohmann, Volker Krner, Frank Koch, Jan-Oliver Herian, Ulrike Theilmann, Lorenz Bartenschlager, Ralf
  ref <302>: TITLE: Replication of subgenomic hepatitis c virus RNAs in a hepatoma cell line
  ref <303>: JOURNAL: Science
  ref <304>: VOLUME: 285
  ref <306>: PAGES: 110-113
  ref <307>: DATE: 1999-07-02
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaagggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggaccgggagatggcagcatcgtgcggaggcgcggttttcgtaggtctgatactcttgaccttgtcaccgcactataagctgttcctcgctaggctcatatggtggttacaatattttatcaccagggccgaggcacacttgcaagtgtggatcccccccctcaacgttcgggggggccgcgatgccgtcatcctcctcacgtgcgcgatccacccagagctaatctttaccatcaccaaaatcttgctcgccatactcggtccactcatggtgctccaggctggtataaccaaagtgccgtacttcgtgcgcgcacacgggctcattcgtgcatgcatgctggtgcggaaggttgctgggggtcattatgtccaaatggctctcatgaagttggccgcactgacaggtacgtacgtttatgaccatctcaccccactgcgggactgggcccacgcgggcctacgagaccttgcggtggcagttgagcccgtcgtcttctctgatatggagaccaaggttatcacctggggggcagacaccgcggcgtgtggggacatcatcttgggcctgcccgtctccgcccgcagggggagggagatacatctgggaccggcagacagccttgaagggcaggggtggcgactcctcgcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaaccggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggcgatttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggacgtagcagtgctcacttccatgctcaccgacccctcccacattacggcggagacggctaagcgtaggctggccaggggatctcccccctccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccacctccacggaggaagaggacggttgtcctgtcagaatctaccgtgtcttctgccttggcggagctcgccacaaagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 5 - protein, 279 aa, Hepatitis C virus
MSTNPKPQRKTKGRAMIEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKARMPDGEDLVVTHGDACLPNIMVENGRFSGFIDCGRLGVADRYQDIALATRDIAEELGGEWADRFLVLYGIAAPDSQRIAFYRLLDEFF

SEQ ID NO: 6 - protein, 2201 aa, Hepatitis C virus
MDREMAASCGGAVFVGLILLTLSPHYKLFLARLIWWLQYFITRAEAHLQVWIPPLNVRGGRDAVILLTCAIHPELIFTITKILLAILGPLMVLQAGITKVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGREIHLGPADSLEGQGWRLLAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGIDPNIRTGVRTITTGAPITYSTYGKFLADGGCSGGAYDIIICDECHSTDSTTILGIGTVLDQAETAGARLVVLATATPPGSVTVPHPNIEEVALSSTGEIPFYGKAIPIETIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTLEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFLVGLNQYLVGSQLPCEPEPDVAVLTSMLTDPSHITAETAKRRLARGSPPSLASSSASQLSAPSLKATCTTRHDSPDADLIEANLLWRQEMGGNITRVESENKVVILDSFEPLQAEEDEREVSVPAEILRRSRKFPRAMPIWARPDYNPPLLESWKDPDYVPPVVHGCPLPPAKAPPIPPPRRKRTVVLSESTVSSALAELATKTFGSSESSAVDSGTATASPDQPSDDGDAGSDVESYSSMPPLEGEPGDPDLSDGSWSTVSEEASEDVVCCSMSYTWTGALITPCAAEETKLPINALSNSLLRHHNLVYATTSRSASLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 7 - DNA, 8001 bp, Hepatitis C virus
  5'UTR (1)..(341): construct I389/NS3-3'/wt
  CDS (342)..(1193): hepatitis  C virus core-neomycin phosphotransferase fusion protein
  RBS (1202)..(1812): internal ribosome entry site from encephalomyocarditis virus
  CDS (1813)..(7770): hepatitis C virus nonstructural proteins NS3-5B
  3'UTR (7771)..(8001)
  ref <301>: AUTHORS: Lohmann, Volker Krner, Frank Koch, Jan-Oliver Herian, Ulrike Theilmann, Lorenz Bartenschlager, Ralf
  ref <302>: TITLE: Replication of subgenomic hepatitis c virus RNAs in a hepatoma cell line
  ref <303>: JOURNAL: Science
  ref <304>: VOLUME: 285
  ref <306>: PAGES: 110-113
  ref <307>: DATE: 1999-07-02
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaaccggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggcgatttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggacgtagcagtgctcacttccatgctcaccgacccctcccacattacggcggagacggctaagcgtaggctggccaggggatctcccccctccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccacctccacggaggaagaggacggttgtcctgtcagaatctaccgtgtcttctgccttggcggagctcgccacaaagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 8 - protein, 283 aa, Hepatitis C virus; identical to SEQ ID NO: 2

SEQ ID NO: 9 - protein, 1985 aa, Hepatitis C virus
MAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGIDPNIRTGVRTITTGAPITYSTYGKFLADGGCSGGAYDIIICDECHSTDSTTILGIGTVLDQAETAGARLVVLATATPPGSVTVPHPNIEEVALSSTGEIPFYGKAIPIETIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTLEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFLVGLNQYLVGSQLPCEPEPDVAVLTSMLTDPSHITAETAKRRLARGSPPSLASSSASQLSAPSLKATCTTRHDSPDADLIEANLLWRQEMGGNITRVESENKVVILDSFEPLQAEEDEREVSVPAEILRRSRKFPRAMPIWARPDYNPPLLESWKDPDYVPPVVHGCPLPPAKAPPIPPPRRKRTVVLSESTVSSALAELATKTFGSSESSAVDSGTATASPDQPSDDGDAGSDVESYSSMPPLEGEPGDPDLSDGSWSTVSEEASEDVVCCSMSYTWTGALITPCAAEETKLPINALSNSLLRHHNLVYATTSRSASLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 10 - DNA, 7989 bp, Hepatitis C virus
  5'UTR (1)..(341): construct I377/NS3-3'/wt
  CDS (342)..(1181): hepatitis C virus core-neomycin phosphotransferase fusion protein
  RBS (1190)..(1800): internal ribosome entry site from encephalomyocarditis virus
  CDS (1801)..(7758): hepatitis C virus NS3 - 5B
  3'UTR (7759)..(7989)
  ref <301>: AUTHORS: Lohmann, Volker Krner, Frank Koch, Jan-Oliver Herian, Ulrike Theilmann, Lorenz Bartenschlager, Ralf
  ref <302>: TITLE: Replication of subgenomic hepatitis c virus RNAs in a hepatoma cell line
  ref <303>: JOURNAL: Science
  ref <304>: VOLUME: 285
  ref <306>: PAGES: 110-113
  ref <307>: DATE: 1999-07-02
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaagggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaaccggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggcgatttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggacgtagcagtgctcacttccatgctcaccgacccctcccacattacggcggagacggctaagcgtaggctggccaggggatctcccccctccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccacctccacggaggaagaggacggttgtcctgtcagaatctaccgtgtcttctgccttggcggagctcgccacaaagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 11 - protein, 279 aa, Hepatitis C virus; identical to SEQ ID NO: 5

SEQ ID NO: 12 - protein, 1985 aa, Hepatitis C virus; identical to SEQ ID NO: 9

SEQ ID NO: 13 - DNA, 8649 bp, Hepatitis C virus
  5'UTR (1)..(341): construct I389/NS2-3'/wt
  CDS (342)..(1193): hepatitis c virus core-neomycin phosphotransferase fusion protein
  RBS (1202)..(1812): internal ribosome entry site of encephalomyocarditis virus
  CDS (1813)..(8418): hepatitis C virus NS2 - 5B
  3'UTR (8419)..(8649)
  ref <301>: AUTHORS: Lohmann, Volker Krner, Frank Koch, Jan-Oliver Herian, Ulrike Theilmann, Lorenz Bartenschlager, Ralf
  ref <302>: TITLE: Replication of subgenomic hepatitis c virus RNAs in a hepatoma cell line
  ref <303>: JOURNAL: Science
  ref <304>: VOLUME: 285
  ref <306>: PAGES: 110-113
  ref <307>: DATE: 1999-07-02
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggaccgggagatggcagcatcgtgcggaggcgcggttttcgtaggtctgatactcttgaccttgtcaccgcactataagctgttcctcgctaggctcatatggtggttacaatattttatcaccagggccgaggcacacttgcaagtgtggatcccccccctcaacgttcgggggggccgcgatgccgtcatcctcctcacgtgcgcgatccacccagagctaatctttaccatcaccaaaatcttgctcgccatactcggtccactcatggtgctccaggctggtataaccaaagtgccgtacttcgtgcgcgcacacgggctcattcgtgcatgcatgctggtgcggaaggttgctgggggtcattatgtccaaatggctctcatgaagttggccgcactgacaggtacgtacgtttatgaccatctcaccccactgcgggactgggcccacgcgggcctacgagaccttgcggtggcagttgagcccgtcgtcttctctgatatggagaccaaggttatcacctggggggcagacaccgcggcgtgtggggacatcatcttgggcctgcccgtctccgcccgcagggggagggagatacatctgggaccggcagacagccttgaagggcaggggtggcgactcctcgcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaaccggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggcgatttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggacgtagcagtgctcacttccatgctcaccgacccctcccacattacggcggagacggctaagcgtaggctggccaggggatctcccccctccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccacctccacggaggaagaggacggttgtcctgtcagaatctaccgtgtcttctgccttggcggagctcgccacaaagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 14 - protein, 283 aa, Hepatitis C virus; identical to SEQ ID NO: 2

SEQ ID NO: 15 - protein, 2201 aa, Hepatitis C virus; identical to SEQ ID NO: 6

SEQ ID NO: 16 - DNA, 8001 bp, Hepatitis C virus
  5'UTR (1)..(341): construct I389/NS3-3'/9-13F
  CDS (342)..(1193): hepatitis C virus core-neomycin phosphotransferase fusion protein
  RBS (1202)..(1812): internal ribosome entry site from encephalomyocarditis virus
  CDS (1813)..(7770): hepatitis C virus nonstructural protein NS3-5B; carries cell culture-adaptive mutations from clone 9-13F
  3'UTR (7771)..(8001)
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcatgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaaccggggtagggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgcgaccatcaagggggggaggcacctcattttctgccattccaagaagaaatgtgatgagctcgccgcgaagctatccggcctcggactcaatgctgtagcatattaccggggccttgatgtatccgtcataccaactagcggagacgtcattgtcgtagcaacggacgctctaatgacgggctttaccggcgatttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggctgcccgtctgccaggaccatctggagttctgggagagcgtctttacaggcctcacccacatagacgcccatttcttgtcccagactaggcaggcaggagacaacttcccctacctggtagcataccaggctacggtgtgcgccagggctcaggctccacctccatcgtgggaccaaatgtgggagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgtctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgggcccgaaccggacgtagcagtgctcacttccatgctcaccgacccctcccacattacggcggagacggctaagcgtaggctggccaggggatctcccccctccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccacctccacggagggagaggacggttgtcctgtcagaatctaccgtgtcttctgccttggcggagctcgccacaaagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccgtcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttatttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 17 - protein, 283 aa, Hepatitis C virus; identical to SEQ ID NO: 2

SEQ ID NO: 18 - protein, 1985 aa, Hepatitis C virus
MAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGIDPNIRTGVGTITTGAPITYSTYGKFLADGGCSGGAYDIIICDECHSTDSTTILGIGTVLDQAETAGARLVVLATATPPGSVTVPHPNIEEVALSSTGEIPFYGKAIPIATIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTRQAGDNFPYLVAYQATVCARAQAPPPSWDQMWECLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTLEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVSESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFLVGLNQYLVGSQLPCGPEPDVAVLTSMLTDPSHITAETAKRRLARGSPPSLASSSASQLSAPSLKATCTTRHDSPDADLIEANLLWRQEMGGNITRVESENKVVILDSFEPLQAEEDEREVSVPAEILRRSRKFPRAMPIWARPDYNPPLLESWKDPDYVPPVVHGCPLPPAKAPPIPPPRRERTVVLSESTVSSALAELATKTFGSSESSAVDSGTATASPDQPSDDGDAGSDVESYSSMPPLEGEPGDPDLSDGSWSTVSEEASEDVVCCSMSYTWTGALITPCAAEETKLPVNALSNSLLRHHNLVYATTSRSASLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 19 - DNA, 11076 bp, Hepatitis C virus
  5'UTR (1)..(341): construct I389/Core-3'/9-13F
  CDS (342)..(1193): hepatitis C virus core - neomycin phosphotransferase fusion protein
  RBS (1202)..(1812): internal ribosome entry site from encephalomyocarditis virus
  CDS (1813)..(10845): hepatitis C virus polyprotein from core to nonstructural protein NS5B; carries cell culture-adaptive mutations from clone 9-13F
  3'UTR (10846)..(11076)
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatgggcacgaatcctaaacctcaaagaaaaaccaaacgtaacaccaaccgccgcccacaggacgtcaagttcccgggcggtggtcagatcgtcggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccctggcccctctatggcaatgagggcttggggtgggcaggatggctcctgtcaccccgtggctctcggcctagttggggccccacggacccccggcgtaggtcgcgcaatttgggtaaggtcatcgataccctcacgtgcggcttcgccgatctcatggggtacattccgctcgtcggcgcccccctagggggcgctgccagggccctggcgcatggcgtccgggttctggaggacggcgtgaactatgcaacagggaatctgcccggttgctccttttctatcttccttttggctttgctgtcctgtttgaccatcccagcttccgcttatgaagtgcgcaacgtatccggagtgtaccatgtcacgaacgactgctccaacgcaagcattgtgtatgaggcagcggacatgatcatgcatacccccgggtgcgtgccctgcgttcgggagaacaactcctcccgctgctgggtagcgctcactcccacgctcgcggccaggaacgctagcgtccccactacgacgatacgacgccatgtcgatttgctcgttggggcggctgctctctgctccgctatgtacgtgggagatctctgcggatctgttttcctcgtcgcccagctgttcaccttctcgcctcgccggcacgagacagtacaggactgcaattgctcaatatatcccggccacgtgacaggtcaccgtatggcttgggatatgatgatgaactggtcacctacagcagccctagtggtatcgcagttactccggatcccacaagctgtcgtggatatggtggcgggggcccattggggagtcctagcgggccttgcctactattccatggtggggaactgggctaaggttctgattgtgatgctactctttgccggcgttgacgggggaacctatgtgacaggggggacgatggccaaaaacaccctcgggattacgtccctcttttcacccgggtcatcccagaaaatccagcttgtaaacaccaacggcagctggcacatcaacaggactgccctgaactgcaatgactccctcaacactgggttccttgctgcgctgttctacgtgcacaagttcaactcatctggatgcccagagcgcatggccagctgcagccccatcgacgcgttcgctcaggggtgggggcccatcacttacaatgagtcacacagctcggaccagaggccttattgttggcactacgcaccccggccgtgcggtatcgtacccgcggcgcaggtgtgtggtccagtgtactgcttcaccccaagccctgtcgtggtggggacgaccgaccggttcggcgtccctacgtacagttggggggagaatgagacggacgtgctgcttcttaacaacacgcggccgccgcaaggcaactggtttggctgtacatggatgaatagcactgggttcaccaagacgtgcgggggccccccgtgtaacatcggggggatcggcaataaaaccttgacctgccccacggactgcttccggaagcaccccgaggccacttacaccaagtgtggttcggggccttggttgacacccagatgcttggtccactacccatacaggctttggcactacccctgcactgtcaactttaccatcttcaaggttaggatgtacgtggggggagtggagcacaggctcgaagccgcatgcaattggactcgaggagagcgttgtaacctggaggacagggacagatcagagcttagcccgctgctgctgtctacaacggagtggcaggtattgccctgttccttcaccaccctaccggctctgtccactggtttgatccatctccatcagaacgtcgtggacgtacaatacctgtacggtatagggtcggcggttgtctcctttgcaatcaaatgggagtatgtcctgttgctcttccttcttctggcggacgcgcgcgtctgtgcctgcttgtggatgatgctgctgatagctcaagctgaggccgccctagagaacctggtggtcctcaacgcggcatccgtggccggggcgcatggcattctctccttcctcgtgttcttctgtgctgcctggtacatcaagggcaggctggtccctggggcggcatatgccctctacggcgtatggccgctactcctgctcctgctggcgttaccaccacgagcatacgccatggaccgggagatggcagcatcgtgcggaggcgcggttttcgtaggtctgatactcttgaccttgtcaccgcactataagctgttcctcgctaggctcatatggtggttacaatattttatcaccagggccgaggcacacttgcaagtgtggatcccccccctcaacgttcgggggggccgcgatgccgtcatcctcctcacgtgcgcgatccacccagagctaatctttaccatcaccaaaatcttgctcgccatactcggtccactcatggtgctccaggctggtataaccaaagtgccgtacttcgtgcgcgcacacgggctcattcgtgcatgcatgctggtgcggaaggttgctgggggtcattatgtccaaatggctctcatgaagttggccgcactgacaggtacgtacgtttatgaccatctcaccccactgcgggactgggcccacgcgggcctacgagaccttgcggtggcagttgagcccgtcgtcttctctgatatggagaccaaggttatcacctggggggcagacaccgcggcgtgtggggacatcatcttgggcctgcccgtctccgcccgcagggggagggagatacatctgggaccggcagacagccttgaagggcaggggtggcgactcctcgcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcatgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaaccggggtagggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgcgaccatcaagggggggaggcacctcattttctgccattccaagaagaaatgtgatgagctcgccgcgaagctatccggcctcggactcaatgctgtagcatattaccggggccttgatgtatccgtcataccaactagcggagacgtcattgtcgtagcaacggacgctctaatgacgggctttaccggcgatttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggctgcccgtctgccaggaccatctggagttctgggagagcgtctttacaggcctcacccacatagacgcccatttcttgtcccagactaggcaggcaggagacaacttcccctacctggtagcataccaggctacggtgtgcgccagggctcaggctccacctccatcgtgggaccaaatgtgggagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgtctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgggcccgaaccggacgtagcagtgctcacttccatgctcaccgacccctcccacattacggcggagacggctaagcgtaggctggccaggggatctcccccctccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccacctccacggagggagaggacggttgtcctgtcagaatctaccgtgtcttctgccttggcggagctcgccacaaagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccgtcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttatttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 20 - protein, 283 aa, Hepatitis C virus; identical to SEQ ID NO: 2

SEQ ID NO: 21 - protein, 3010 aa, Hepatitis C virus
MGTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVVDMVAGAHWGVLAGLAYYSMVGNWAKVLIVMLLFAGVDGGTYVTGGTMAKNTLGITSLFSPGSSQKIQLVNTNGSWHINRTALNCNDSLNTGFLAALFYVHKFNSSGCPERMASCSPIDAFAQGWGPITYNESHSSDQRPYCWHYAPRPCGIVPAAQVCGPVYCFTPSPVVVGTTDRFGVPTYSWGENETDVLLLNNTRPPQGNWFGCTWMNSTGFTKTCGGPPCNIGGIGNKTLTCPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLILLTLSPHYKLFLARLIWWLQYFITRAEAHLQVWIPPLNVRGGRDAVILLTCAIHPELIFTITKILLAILGPLMVLQAGITKVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGREIHLGPADSLEGQGWRLLAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGIDPNIRTGVGTITTGAPITYSTYGKFLADGGCSGGAYDIIICDECHSTDSTTILGIGTVLDQAETAGARLVVLATATPPGSVTVPHPNIEEVALSSTGEIPFYGKAIPIATIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTRQAGDNFPYLVAYQATVCARAQAPPPSWDQMWECLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTLEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVSESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFLVGLNQYLVGSQLPCGPEPDVAVLTSMLTDPSHITAETAKRRLARGSPPSLASSSASQLSAPSLKATCTTRHDSPDADLIEANLLWRQEMGGNITRVESENKVVILDSFEPLQAEEDEREVSVPAEILRRSRKFPRAMPIWARPDYNPPLLESWKDPDYVPPVVHGCPLPPAKAPPIPPPRRERTVVLSESTVSSALAELATKTFGSSESSAVDSGTATASPDQPSDDGDAGSDVESYSSMPPLEGEPGDPDLSDGSWSTVSEEASEDVVCCSMSYTWTGALITPCAAEETKLPVNALSNSLLRHHNLVYATTSRSASLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 22 - DNA, 8001 bp, Hepatitis C virus
  5'UTR (1)..(341): construct I389/NS3-3'/5.1
  CDS (342)..(1193): hepatitis C virus core - neomycin phosphotransferase fusion protein
  RBS (1202)..(1812): internal ribosome entry site from encephalomyocarditis virus
  CDS (1813)..(7770): hepatitis C virus nonstructural proteins NS3 - 5B of cell culture-adapted clone no. 5.1
  5'UTR (7771)..(8001)
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaatcggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggtgacttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccatcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggggcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacgacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggatgtagcagtgctcacttccatgctcaccgacccctcccacattacggcggagacggctaagcgtaggctggccaggggatctcctccccccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccaccttcacggaggaagaggacggttgtcctgtcagaatctaccgtgtcttctgccttggcggagctcgccacagagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 23 - protein, 283 aa, Hepatitis C virus; identical to SEQ ID NO: 2

SEQ ID NO: 24 - protein, 1985 aa, Hepatitis C virus
MAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGIDPNIRIGVRTITTGAPITYSTYGKFLADGGCSGGAYDIIICDECHSTDSTTILGIGTVLDQAETAGARLVVLATATPPGSVTVPHPNIEEVALSSTGEIPFYGKAIPIETIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTIEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVAAEEYVEVTRVGDFHYVTGMTTDDVKCPCQVPAPEFFTEVDGVRLHRYAPACKPLLREEVTFLVGLNQYLVGSQLPCEPEPDVAVLTSMLTDPSHITAETAKRRLARGSPPPLASSSASQLSAPSLKATCTTRHDSPDADLIEANLLWRQEMGGNITRVESENKVVILDSFEPLQAEEDEREVSVPAEILRRSRKFPRAMPIWARPDYNPPLLESWKDPDYVPPVVHGCPLPPAKAPPIPPSRRKRTVVLSESTVSSALAELATETFGSSESSAVDSGTATASPDQPSDDGDAGSDVESYSSMPPLEGEPGDPDLSDGSWSTVSEEASEDVVCCSMSYTWTGALITPCAAEETKLPINALSNSLLRHHNLVYATTSRSASLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 25 - DNA, 11076 bp, Hepatitis C virus
  5'UTR (1)..(341): construct I389/Core-3'/5.1
  CDS (342)..(1193): hepatitis C virus core - neomycin phosphotransferase fusion protein
  RBS (1202)..(1812): internal ribosome entry site from encephalomyocarditis virus
  CDS (1813)..(10845): hepatitis C virus polyprotein from core to nonstructural protein NS5B; carries cell culture-adaptive mutations of clone 5.1
  3'UTR (10846)..(11076)
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatgggcacgaatcctaaacctcaaagaaaaaccaaacgtaacaccaaccgccgcccacaggacgtcaagttcccgggcggtggtcagatcgtcggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccctggcccctctatggcaatgagggcttggggtgggcaggatggctcctgtcaccccgtggctctcggcctagttggggccccacggacccccggcgtaggtcgcgcaatttgggtaaggtcatcgataccctcacgtgcggcttcgccgatctcatggggtacattccgctcgtcggcgcccccctagggggcgctgccagggccctggcgcatggcgtccgggttctggaggacggcgtgaactatgcaacagggaatctgcccggttgctccttttctatcttccttttggctttgctgtcctgtttgaccatcccagcttccgcttatgaagtgcgcaacgtatccggagtgtaccatgtcacgaacgactgctccaacgcaagcattgtgtatgaggcagcggacatgatcatgcatacccccgggtgcgtgccctgcgttcgggagaacaactcctcccgctgctgggtagcgctcactcccacgctcgcggccaggaacgctagcgtccccactacgacgatacgacgccatgtcgatttgctcgttggggcggctgctctctgctccgctatgtacgtgggagatctctgcggatctgttttcctcgtcgcccagctgttcaccttctcgcctcgccggcacgagacagtacaggactgcaattgctcaatatatcccggccacgtgacaggtcaccgtatggcttgggatatgatgatgaactggtcacctacagcagccctagtggtatcgcagttactccggatcccacaagctgtcgtggatatggtggcgggggcccattggggagtcctagcgggccttgcctactattccatggtggggaactgggctaaggttctgattgtgatgctactctttgccggcgttgacgggggaacctatgtgacaggggggacgatggccaaaaacaccctcgggattacgtccctcttttcacccgggtcatcccagaaaatccagcttgtaaacaccaacggcagctggcacatcaacaggactgccctgaactgcaatgactccctcaacactgggttccttgctgcgctgttctacgtgcacaagttcaactcatctggatgcccagagcgcatggccagctgcagccccatcgacgcgttcgctcaggggtgggggcccatcacttacaatgagtcacacagctcggaccagaggccttattgttggcactacgcaccccggccgtgcggtatcgtacccgcggcgcaggtgtgtggtccagtgtactgcttcaccccaagccctgtcgtggtggggacgaccgaccggttcggcgtccctacgtacagttggggggagaatgagacggacgtgctgcttcttaacaacacgcggccgccgcaaggcaactggtttggctgtacatggatgaatagcactgggttcaccaagacgtgcgggggccccccgtgtaacatcggggggatcggcaataaaaccttgacctgccccacggactgcttccggaagcaccccgaggccacttacaccaagtgtggttcggggccttggttgacacccagatgcttggtccactacccatacaggctttggcactacccctgcactgtcaactttaccatcttcaaggttaggatgtacgtggggggagtggagcacaggctcgaagccgcatgcaattggactcgaggagagcgttgtaacctggaggacagggacagatcagagcttagcccgctgctgctgtctacaacggagtggcaggtattgccctgttccttcaccaccctaccggctctgtccactggtttgatccatctccatcagaacgtcgtggacgtacaatacctgtacggtatagggtcggcggttgtctcctttgcaatcaaatgggagtatgtcctgttgctcttccttcttctggcggacgcgcgcgtctgtgcctgcttgtggatgatgctgctgatagctcaagctgaggccgccctagagaacctggtggtcctcaacgcggcatccgtggccggggcgcatggcattctctccttcctcgtgttcttctgtgctgcctggtacatcaagggcaggctggtccctggggcggcatatgccctctacggcgtatggccgctactcctgctcctgctggcgttaccaccacgagcatacgccatggaccgggagatggcagcatcgtgcggaggcgcggttttcgtaggtctgatactcttgaccttgtcaccgcactataagctgttcctcgctaggctcatatggtggttacaatattttatcaccagggccgaggcacacttgcaagtgtggatcccccccctcaacgttcgggggggccgcgatgccgtcatcctcctcacgtgcgcgatccacccagagctaatctttaccatcaccaaaatcttgctcgccatactcggtccactcatggtgctccaggctggtataaccaaagtgccgtacttcgtgcgcgcacacgggctcattcgtgcatgcatgctggtgcggaaggttgctgggggtcattatgtccaaatggctctcatgaagttggccgcactgacaggtacgtacgtttatgaccatctcaccccactgcgggactgggcccacgcgggcctacgagaccttgcggtggcagttgagcccgtcgtcttctctgatatggagaccaaggttatcacctggggggcagacaccgcggcgtgtggggacatcatcttgggcctgcccgtctccgcccgcagggggagggagatacatctgggaccggcagacagccttgaagggcaggggtggcgactcctcgcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaatcggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggtgacttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccatcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggggcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacgacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggatgtagcagtgctcacttccatgctcaccgacccctcccacattacggcggagacggctaagcgtaggctggccaggggatctcctccccccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccaccttcacggaggaagaggacggttgtcctgtcagaatctaccgtgtcttctgccttggcggagctcgccacagagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 26 - protein, 283 aa, Hepatitis C virus; identical to SEQ ID NO: 2

SEQ ID NO: 27 - protein, 3010 aa, Hepatitis C virus
MGTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVVDMVAGAHWGVLAGLAYYSMVGNWAKVLIVMLLFAGVDGGTYVTGGTMAKNTLGITSLFSPGSSQKIQLVNTNGSWHINRTALNCNDSLNTGFLAALFYVHKFNSSGCPERMASCSPIDAFAQGWGPITYNESHSSDQRPYCWHYAPRPCGIVPAAQVCGPVYCFTPSPVVVGTTDRFGVPTYSWGENETDVLLLNNTRPPQGNWFGCTWMNSTGFTKTCGGPPCNIGGIGNKTLTCPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLILLTLSPHYKLFLARLIWWLQYFITRAEAHLQVWIPPLNVRGGRDAVILLTCAIHPELIFTITKILLAILGPLMVLQAGITKVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGREIHLGPADSLEGQGWRLLAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGIDPNIRIGVRTITTGAPITYSTYGKFLADGGCSGGAYDIIICDECHSTDSTTILGIGTVLDQAETAGARLVVLATATPPGSVTVPHPNIEEVALSSTGEIPFYGKAIPIETIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTIEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVAAEEYVEVTRVGDFHYVTGMTTDDVKCPCQVPAPEFFTEVDGVRLHRYAPACKPLLREEVTFLVGLNQYLVGSQLPCEPEPDVAVLTSMLTDPSHITAETAKRRLARGSPPPLASSSASQLSAPSLKATCTTRHDSPDADLIEANLLWRQEMGGNITRVESENKVVILDSFEPLQAEEDEREVSVPAEILRRSRKFPRAMPIWARPDYNPPLLESWKDPDYVPPVVHGCPLPPAKAPPIPPSRRKRTVVLSESTVSSALAELATETFGSSESSAVDSGTATASPDQPSDDGDAGSDVESYSSMPPLEGEPGDPDLSDGSWSTVSEEASEDVVCCSMSYTWTGALITPCAAEETKLPINALSNSLLRHHNLVYATTSRSASLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 28 - DNA, 8001 bp, Hepatitis C virus
  5'UTR (1)..(341): construct I389/NS3-3'/19
  CDS (342)..(1193): hepatitis C virus core - neomycin phosphotransferase fusion protein
  RBS (1202)..(1812): internal ribosome entry site from encephalomyocarditis virus
  CDS (1813)..(7770): hepatitis C virus nonstructural proteins NS3 - 5B of cell culture adapted clone no. 19
  3'UTR (7771)..(8001)
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatgggaaccactatgcggtccccggtcttcacggacaactcgtcccctccggccgtaccgcagacattccaggtggcccatctacacgcccctactggtagcggcaagagcactaaggtgccggctgcgtatgcaggccaagggtataaggtgcttgtcctgaacccgtccgtcgccgccaccctaggtttcggggcgtatatgtctaaggcacatggtatcgaccctaacatcagaatcggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggcgacttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccatcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagttgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgagtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtaggtgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcctgaaccggatgtagcagtgctcacttccatgctcaccgacccctcccacattacggcggagacggctaagcgtaggctggccaggggatctcccccccccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagaggggagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccaccttcacggaggaagaggacggttgtcctgtcagaatctaccgtgtcttctgccttggcggagctcgccacagagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaaacctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 29 - protein, 283 aa, Hepatitis C virus; identical to SEQ ID NO: 2

SEQ ID NO: 30 - protein, 1985 aa, Hepatitis C virus
MAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMGTTMRSPVFTDNSSPPAVPQTFQVAHLHAPTGSGKSTKVPAAYAGQGYKVLVLNPSVAATLGFGAYMSKAHGIDPNIRIGVRTITTGAPITYSTYGKFLADGGCSGGAYDIIICDECHSTDSTTILGIGTVLDQAETAGARLVVLATATPPGSVTVPHPNIEEVALSSTGEIPFYGKAIPIETIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTIEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGELPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVGAEEYVEVTRVGDFHYVTGMTTDNVKCPCQVPAPEFFTEVDGVRLHRYAPACKPLLREEVTFLVGLNQYLVGSQLPCEPEPDVAVLTSMLTDPSHITAETAKRRLARGSPPPLASSSASQLSAPSLKATCTTRHDSPDADLIEANLLWRQEMGGNITRVESENKVVILDSFEPLQAEEDERGVSVPAEILRRSRKFPRAMPIWARPDYNPPLLESWKDPDYVPPVVHGCPLPPAKAPPIPPSRRKRTVVLSESTVSSALAELATETFGSSESSAVDSGTATASPDQPSDDGDAGSDVESYSSMPPLEGEPGDPDLSDGSWSTVSEEASEDVVCCSMSYTWTGALITPCAAEETKLPINALSNSLLRHHNLVYATTSRSANLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 31 - DNA, 11076 bp, Hepatitis C virus
  5'UTR (1)..(341): construct I389/Core-3'/19
  CDS (342)..(1193): hepatitis C virus core - neomycin phosphotransferase fusion protein
  RBS (1202)..(1812): internal ribosome entry site from encephalomyocarditis virus
  CDS (1813)..(10845): hepatitis C virus polyprotein from core to nonstructural protein NS5B; carries cell culture adaptive mutations from clone no. 19
  3'UTR (10846)..(11076)
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacgggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatgggcacgaatcctaaacctcaaagaaaaaccaaacgtaacaccaaccgccgcccacaggacgtcaagttcccgggcggtggtcagatcgtcggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccctggcccctctatggcaatgagggcttggggtgggcaggatggctcctgtcaccccgtggctctcggcctagttggggccccacggacccccggcgtaggtcgcgcaatttgggtaaggtcatcgataccctcacgtgcggcttcgccgatctcatggggtacattccgctcgtcggcgcccccctagggggcgctgccagggccctggcgcatggcgtccgggttctggaggacggcgtgaactatgcaacagggaatctgcccggttgctccttttctatcttccttttggctttgctgtcctgtttgaccatcccagcttccgcttatgaagtgcgcaacgtatccggagtgtaccatgtcacgaacgactgctccaacgcaagcattgtgtatgaggcagcggacatgatcatgcatacccccgggtgcgtgccctgcgttcgggagaacaactcctcccgctgctgggtagcgctcactcccacgctcgcggccaggaacgctagcgtccccactacgacgatacgacgccatgtcgatttgctcgttggggcggctgctctctgctccgctatgtacgtgggagatctctgcggatctgttttcctcgtcgcccagctgttcaccttctcgcctcgccggcacgagacagtacaggactgcaattgctcaatatatcccggccacgtgacaggtcaccgtatggcttgggatatgatgatgaactggtcacctacagcagccctagtggtatcgcagttactccggatcccacaagctgtcgtggatatggtggcgggggcccattggggagtcctagcgggccttgcctactattccatggtggggaactgggctaaggttctgattgtgatgctactctttgccggcgttgacgggggaacctatgtgacaggggggacgatggccaaaaacaccctcgggattacgtccctcttttcacccgggtcatcccagaaaatccagcttgtaaacaccaacggcagctggcacatcaacaggactgccctgaactgcaatgactccctcaacactgggttccttgctgcgctgttctacgtgcacaagttcaactcatctggatgcccagagcgcatggccagctgcagccccatcgacgcgttcgctcaggggtgggggcccatcacttacaatgagtcacacagctcggaccagaggccttattgttggcactacgcaccccggccgtgcggtatcgtacccgcggcgcaggtgtgtggtccagtgtactgcttcaccccaagccctgtcgtggtggggacgaccgaccggttcggcgtccctacgtacagttggggggagaatgagacggacgtgctgcttcttaacaacacgcggccgccgcaaggcaactggtttggctgtacatggatgaatagcactgggttcaccaagacgtgcgggggccccccgtgtaacatcggggggatcggcaataaaaccttgacctgccccacggactgcttccggaagcaccccgaggccacttacaccaagtgtggttcggggccttggttgacacccagatgcttggtccactacccatacaggctttggcactacccctgcactgtcaactttaccatcttcaaggttaggatgtacgtggggggagtggagcacaggctcgaagccgcatgcaattggactcgaggagagcgttgtaacctggaggacagggacagatcagagcttagcccgctgctgctgtctacaacggagtggcaggtattgccctgttccttcaccaccctaccggctctgtccactggtttgatccatctccatcagaacgtcgtggacgtacaatacctgtacggtatagggtcggcggttgtctcctttgcaatcaaatgggagtatgtcctgttgctcttccttcttctggcggacgcgcgcgtctgtgcctgcttgtggatgatgctgctgatagctcaagctgaggccgccctagagaacctggtggtcctcaacgcggcatccgtggccggggcgcatggcattctctccttcctcgtgttcttctgtgctgcctggtacatcaagggcaggctggtccctggggcggcatatgccctctacggcgtatggccgctactcctgctcctgctggcgttaccaccacgagcatacgccatggaccgggagatggcagcatcgtgcggaggcgcggttttcgtaggtctgatactcttgaccttgtcaccgcactataagctgttcctcgctaggctcatatggtggttacaatattttatcaccagggccgaggcacacttgcaagtgtggatcccccccctcaacgttcgggggggccgcgatgccgtcatcctcctcacgtgcgcgatccacccagagctaatctttaccatcaccaaaatcttgctcgccatactcggtccactcatggtgctccaggctggtataaccaaagtgccgtacttcgtgcgcgcacacgggctcattcgtgcatgcatgctggtgcggaaggttgctgggggtcattatgtccaaatggctctcatgaagttggccgcactgacaggtacgtacgtttatgaccatctcaccccactgcgggactgggcccacgcgggcctacgagaccttgcggtggcagttgagcccgtcgtcttctctgatatggagaccaaggttatcacctggggggcagacaccgcggcgtgtggggacatcatcttgggcctgcccgtctccgcccgcagggggagggagatacatctgggaccggcagacagccttgaagggcaggggtggcgactcctcgcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatgggaaccactatgcggtccccggtcttcacggacaactcgtcccctccggccgtaccgcagacattccaggtggcccatctacacgcccctactggtagcggcaagagcactaaggtgccggctgcgtatgcaggccaagggtataaggtgcttgtcctgaacccgtccgtcgccgccaccctaggtttcggggcgtatatgtctaaggcacatggtatcgaccctaacatcagaatcggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggcgacttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccatcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagttgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgagtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtaggtgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcctgaaccggatgtagcagtgctcacttccatgctcaccgacccctcccacattacggcggagacggctaagcgtaggctggccaggggatctcccccccccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagaggggagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccaccttcacggaggaagaggacggttgtcctgtcagaatctaccgtgtcttctgccttggcggagctcgccacagagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaaacctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 32 - protein, 283 aa, Hepatitis C virus; identical to SEQ ID NO: 2

SEQ ID NO: 33 - protein, 3010 aa, Hepatitis C virus
MGTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVVDMVAGAHWGVLAGLAYYSMVGNWAKVLIVMLLFAGVDGGTYVTGGTMAKNTLGITSLFSPGSSQKIQLVNTNGSWHINRTALNCNDSLNTGFLAALFYVHKFNSSGCPERMASCSPIDAFAQGWGPITYNESHSSDQRPYCWHYAPRPCGIVPAAQVCGPVYCFTPSPVVVGTTDRFGVPTYSWGENETDVLLLNNTRPPQGNWFGCTWMNSTGFTKTCGGPPCNIGGIGNKTLTCPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLILLTLSPHYKLFLARLIWWLQYFITRAEAHLQVWIPPLNVRGGRDAVILLTCAIHPELIFTITKILLAILGPLMVLQAGITKVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGREIHLGPADSLEGQGWRLLAPITAYSQQTRGLLGCIITSLTGRDRNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMGTTMRSPVFTDNSSPPAVPQTFQVAHLHAPTGSGKSTKVPAAYAGQGYKVLVLNPSVAATLGFGAYMSKAHGIDPNIRIGVRTITTGAPITYSTYGKFLADGGCSGGAYDIIICDECHSTDSTTILGIGTVLDQAETAGARLVVLATATPPGSVTVPHPNIEEVALSSTGEIPFYGKAIPIETIKGGRHLIFCHSKKKCDELAAKLSGLGLNAVAYYRGLDVSVIPTSGDVIVVATDALMTGFTGDFDSVIDCNTCVTQTVDFSLDPTFTIETTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTTTHPITKYIMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTIEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGELPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPRTCSNTWHGTFPINAYTTGPCTPSPAPNYSRALWRVGAEEYVEVTRVGDFHYVTGMTTDNVKCPCQVPAPEFFTEVDGVRLHRYAPACKPLLREEVTFLVGLNQYLVGSQLPCEPEPDVAVLTSMLTDPSHITAETAKRRLARGSPPPLASSSASQLSAPSLKATCTTRHDSPDADLIEANLLWRQEMGGNITRVESENKVVILDSFEPLQAEEDERGVSVPAEILRRSRKFPRAMPIWARPDYNPPLLESWKDPDYVPPVVHGCPLPPAKAPPIPPSRRKRTVVLSESTVSSALAELATETFGSSESSAVDSGTATASPDQPSDDGDAGSDVESYSSMPPLEGEPGDPDLSDGSWSTVSEEASEDVVCCSMSYTWTGALITPCAAEETKLPINALSNSLLRHHNLVYATTSRSANLRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKAKKCPMGFAYDTRCFDSTVTENDIRVEESIYQCCDLAPEARQAIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRARLLSQGGRAATCGKYLFNWAVRTKLKLTPIPAASQLDLSSWFVAGYSGGDIYHSLSRARPRWFMWCLLLLSVGVGIYLLPNR

SEQ ID NO: 34 - DNA, 18 bp, Bacteriophage T7
  promoter (1)..(18): truncated promoter for DNA-dependant RNA polymerase from bacteriophage T7
taatacgactcactatag

SEQ ID NO: 35 - DNA, 25 bp, Hepatitis C virus
  primer_bind (1)..(25): HCV-specific antisense primer; 5' end at position 4919
agcacagcccgcgtcatagcactcg

SEQ ID NO: 36 - DNA, 24 bp, Hepatitis C virus
  primer_bind (1)..(24): HCV-specific antisense primer; 5' end at position 6103
gctatcagccggttcatccactgc

SEQ ID NO: 37 - DNA, 23 bp, Hepatitis C virus
  primer_bind (1)..(23): HCV-specific antisense primer; 5' end at position 9386
ttagctccccgttcatcggttgg

SEQ ID NO: 38 - DNA, 23 bp, Hepatitis C virus
  primer_bind (1)..(23): HCV-specific antisense primer; 5' end at position 9413
caggatggcctattggcctggag

SEQ ID NO: 39 - DNA, 24 bp, Hepatitis C virus
  primer_bind (1)..(24): HCV-specific sense primer; 5' end at position 4542
gatgagctcgccgcgaagctgtcc

SEQ ID NO: 40 - DNA, 24 bp, Hepatitis C virus
  primer_bind (1)..(24): HCV-specific sense primer; 5' end at position 59
tgtcttcacgcagaaagcgtctag

SEQ ID NO: 41 - DNA, 24 bp, Transposon Tn
  primer_bind (1)..(24): antisense primer specific for the gene encoding neomycin phosphotransferase
cttgagcctggcgaacagttcggc

SEQ ID NO: 42 - DNA, 24 bp, Transposon Tn
  primer_bind (1)..(24): sense primer specific for the gene encoding neomycin phosphotransferase
tcaagaccgacctgtccggtgccc

SEQ ID NO: 43 - DNA, 111 bp, Hepatitis C virus
  3'UTR (1)..(111): novel 3' NTR of hepatitis C virus; clone 6a
acggggagctaaacactccaggccaataggccatcctgtttttttttttagcttttttttttttctttttttttgagagagagagtctcactctgttgcccagactggagt

SEQ ID NO: 44 - DNA, 109 bp, Hepatitis C virus
  3'UTR (1)..(109): novel 3' NTR of hepatitis C virus; clone 6b
acggggagctaaacactccaggccaataggccatcctgtttttttttttagtcttttttttttcttttttttgagagagagagtctcactctgttgcccagactggagc

SEQ ID NO: 45 - DNA, 109 bp, Hepatitis C virus
  3'UTR (1)..(109): novel 3' NTR of hepatitis C virus; clone 6c
acggggagctaaacactccaggccaataggccatcctgtttttttttaatctttttttttttctttttttttgagagagagagtctcactctgttgcccagactgcagc

SEQ ID NO: 46 - DNA, 112 bp, Hepatitis C virus
  3'UTR (1)..(112): novel 3' NTR of hepatitis C virus; clone 6d
acggggagctaaacactccaggccaataggccatcctgttttttttttttagtctttttttttttctttttttttgagagagagagtctcactctgttgcccagactggagt

SEQ ID NO: 47 - DNA, 112 bp, Hepatitis C virus
  3'UTR (1)..(112): novel 3' NTR of hepatitis C virus; clone 6e
acggggagctaaacactccaggccaataggccatcctgtttttttttttagtcttttttttttttctttttttttgagagagagagtctcactctgttgcccagactggagt

SEQ ID NO: 48 - DNA, 113 bp, Hepatitis C virus
  3'UTR (1)..(113): novel 3' NTR of hepatitis C virus; clone 6f
acggggagctaaacactccaggccaataggccatcctgtttttttttttagtcttttttttttttcttttttttttgagagagagagtctcactctgttgcccagactggagt

SEQ ID NO: 49 - DNA, 111 bp, Hepatitis C virus
  3'UTR (1)..(111): novel 3' NTR of hepatitis C virus; clone 6g
acggggagctaaacactccaggccaataggccatcctgtttttttttttagtctttttttttttctttttttttgagagagagagtctcactctgttgcccagactggagt

SEQ ID NO: 50 - DNA, 115 bp, Hepatitis C virus
  3'UTR (1)..(115): novel 3' NTR of hepatitis C virus; clone 6h
acggggagctaaacactccaggccaataggccatcctgtttttttttttttaatcttttttttttttttcctttttttgagagagagagtctcactctgttgcccagactggagt

SEQ ID NO: 51 - DNA, 116 bp, Hepatitis C virus
  3'UTR (1)..(116): novel 3' NTR of hepatitis C virus; clone 6i
acggggagctaaacactccaggccaataggccatcctgttttttttttttaatcttttttttttttttcttttttttttgagagagagagtctcactctgttgcccagactggagt

What is claimed is:

1. A hepatitis-C-virus (HCV) RNA construct with the ability to replicate in eukaryotic cells, said HCV RNA construct is encoded by the nucleotide sequence depicted in SEQ ID NO:10, said nucleotide sequence coding for the HCV specific RNA-segments 5'to NTR, NS3, NS4A, NS4B, NS5A, NS5B and 3'to NTR and additionally for a marker gene for selection, wherein the marker gene for selection is the neomycin phosphotransferase gene.

2. A hepatitis-C-virus (HCV) RNA construct with the ability to replicate in eukaryotic cells, said HCV RNA construct comprising portions of the nucleotide sequence depicted in SEQ ID NO:10, said portions coding for the HCV specific RNA-segments 5'to NTR, NS3, NS4A, NS4B, NS5A, NS5S and 3'to NTR, and said HCV RNA construct further comprising a marker gene for selection or a reporter gene.

3. The HCV RNA construct according to claim 2, wherein said reporter gene is an integrated reporter gene.

4. The HCV RNA construct according to claim 2, wherein said reporter gene is selected from the group consisting of the luciferase genes, the CAT-gene (chloramphenicol acetyl transferase gene), the lacZ gene (beta galactosidase gene), the GFP genes (green fluorescence protein genes), the GUS gene (glucuronidase gene) and the SEAP gene (secreted alkaline phosphatase gene).

5. The HCV RNA construct according to claim 2, wherein when said construct is introduced in eukaryotic cells, where the replication of said construct influences the expression of a surrogate marker gene in said eukaryotic cells.

6. The HCV RNA construct according to claim 2, wherein said construct further comprises an integrated foreign gene and wherein said construct is capable of introducing said foreign gene into a target cell, said target cell being suited for expressing said foreign gene.

7. A mutated construct of the HCV RNA construct according to claim 2, wherein said mutated construct comprises nucleotide mutations and is cell culture-adapted and replicates with high efficiency.

8. The HCV RNA construct according to claim 7, obtainable by a process comprising the steps of (i) providing a cell culture system comprising eukaryotic cells;

(ii) transferring into said eukaryotic cells the HCV RNA construct having the ability to replicate in eukaryotic cells, said HCV RNA construct comprising portions of the nucleotide sequence depicted in SEQ ID NO:10, said portions coding for the HCV specific RNA-segments 5'to NTR, NS3, NS4A, NS4B, NS5A, NS5B and 3'to NTR, and said HCV RNA construct further comprising a marker gene for selection or a reporter gene;

(iii) culturing said eukaryotic cells in/on a suitable selection medium, leading to cell clones;

(iv) harvesting said cell clones; and (v) isolating said mutated HCV RNA construct from said cell clones.

9. The HCV RNA construct according to claim 8, wherein said isolated HCV RNA construct of step (v) is reintroduced into said cell culture system of step (i).

10. The HCV RNA construct according to claim 2, wherein said construct is cell culture adapted and replicates with high efficiency, and said construct encodes an HCV protein, said HCV protein comprises at least one of the following specified amino acid exchanges wherein the amino acid positions relate to the positions of the entire polyprotein of the HCV Con-1 isolate (EMBL accession number AJ 238799): 1283 arg→gly; 1383 glu→ala; 1577 lys→arg; 1609 lys→glu; 1936 pro→ser; 2163 glu→gly; 2330 lye→glu and 2442 ile→val.

11. The HCV RNA construct according to claim 2, wherein said construct comprises a marker gene and a reporter gene.

12. The HCV RNA construct according to claim 11, wherein said marker gene and said reporter gene are spatially arranged in said construct in such a way that they are expressed together as a fusion protein.

13. The HCV RNA construct according to claim 2, wherein said marker gene for selection is an antibiotic resistance gene.

14. The HCV RNA construct according to claim 2, wherein said construct comprises at least one of the nucleotide exchanges depicted in table 3.

15. The HCV RNA construct according to claim 2, wherein said construct encodes a protein, said protein comprises at least one of the amino acid exchanges depicted in table 3.

16. The HCV RNA construct according to claim 2, wherein said eukaryotic cells are human hepatoma cells.

17. The HCV RNA construct according to claim 2, deposited at the DSMZ, Braunschweig, FRG, under the deposit number DSM ACC2394 on Mar. 24, 1999.

* * * * *

UNITED STATES PATENT AND TRADEMARK OFFICE
CERTIFICATE OF CORRECTION

PATENT NO.    : 6,630,343 B1                                                  Page 1 of 1
DATED         : October 7, 2003
INVENTOR(S)   : Ralf Bartenschlager It is certified that error appears in the above-identified patent and that said Letters Patent is hereby corrected as shown below:

<u>Column 34,</u>
Line 36, should read as -- 2330 lys → glu and 2442 ile → val --

Signed and Sealed this

Ninth Day of December, 2003

JAMES E. ROGAN
*Director of the United States Patent and Trademark Office*

UNITED STATES PATENT AND TRADEMARK OFFICE
CERTIFICATE OF CORRECTION

PATENT NO. : 6,630,343 B1 Page 1 of 1
DATED : October 7, 2003
INVENTOR(S) : Ralf Bartenschlager It is certified that error appears in the above-identified patent and that said Letters Patent is hereby corrected as shown below:

<u>Title page, Item [54] and Column 1, line 1,</u>
Title should read as: -- HEPATITIS C VIRUS CELL CULTURE SYSTEM --

Signed and Sealed this

Second Day of March, 2004

JON W. DUDAS
*Acting Director of the United States Patent and Trademark Office*